United States Patent 10,655,128 (COMPOSITIONS AND METHODS FOR MODULATING MECP2 EXPRESSION) - sequence listing, part 3

SEQ ID NO: 75855 - DNA, 15 bp, Homo sapiens
ggccgcagtggagag

SEQ ID NO: 75856 - DNA, 15 bp, Homo sapiens
gccgcagtggagagc

SEQ ID NO: 75857 - DNA, 15 bp, Homo sapiens
ccgcagtggagagca

SEQ ID NO: 75858 - DNA, 15 bp, Homo sapiens
cgcagtggagagcag

SEQ ID NO: 75859 - DNA, 15 bp, Homo sapiens
gcagtggagagcagg

SEQ ID NO: 75860 - DNA, 15 bp, Homo sapiens
cagtggagagcaggg

SEQ ID NO: 75861 - DNA, 15 bp, Homo sapiens
agtggagagcagggt

SEQ ID NO: 75862 - DNA, 15 bp, Homo sapiens
gtggagagcagggtt

SEQ ID NO: 75863 - DNA, 15 bp, Homo sapiens
tggagagcagggttc

SEQ ID NO: 75864 - DNA, 15 bp, Homo sapiens
ggagagcagggttcc

SEQ ID NO: 75865 - DNA, 15 bp, Homo sapiens
gagagcagggttccg

SEQ ID NO: 75866 - DNA, 15 bp, Homo sapiens
agagcagggttccgg

SEQ ID NO: 75867 - DNA, 15 bp, Homo sapiens
gagcagggttccggc

SEQ ID NO: 75868 - DNA, 15 bp, Homo sapiens
agcagggttccggca

SEQ ID NO: 75869 - DNA, 15 bp, Homo sapiens
gcagggttccggcag

SEQ ID NO: 75870 - DNA, 15 bp, Homo sapiens
cagggttccggcagg

SEQ ID NO: 75871 - DNA, 15 bp, Homo sapiens
agggttccggcaggg

SEQ ID NO: 75872 - DNA, 15 bp, Homo sapiens
gggttccggcagggc

SEQ ID NO: 75873 - DNA, 15 bp, Homo sapiens
ggttccggcagggcc

SEQ ID NO: 75874 - DNA, 15 bp, Homo sapiens
gttccggcagggccg

SEQ ID NO: 75875 - DNA, 15 bp, Homo sapiens
ttccggcagggccgc

SEQ ID NO: 75876 - DNA, 15 bp, Homo sapiens
tccggcagggccgcc

SEQ ID NO: 75877 - DNA, 15 bp, Homo sapiens
ccggcagggccgccc

SEQ ID NO: 75878 - DNA, 15 bp, Homo sapiens
cggcagggccgccca

SEQ ID NO: 75879 - DNA, 15 bp, Homo sapiens
ggcagggccgcccag

SEQ ID NO: 75880 - DNA, 15 bp, Homo sapiens
gcagggccgcccagg

SEQ ID NO: 75881 - DNA, 15 bp, Homo sapiens
cagggccgcccagga

SEQ ID NO: 75882 - DNA, 15 bp, Homo sapiens
agggccgcccaggag

SEQ ID NO: 75883 - DNA, 15 bp, Homo sapiens
gggccgcccaggagc

SEQ ID NO: 75884 - DNA, 15 bp, Homo sapiens
ggccgcccaggagct

SEQ ID NO: 75885 - DNA, 15 bp, Homo sapiens
gccgcccaggagctt

SEQ ID NO: 75886 - DNA, 15 bp, Homo sapiens
ccgcccaggagcttt

SEQ ID NO: 75887 - DNA, 15 bp, Homo sapiens
cgcccaggagctttc

SEQ ID NO: 75888 - DNA, 15 bp, Homo sapiens
gcccaggagctttcg

SEQ ID NO: 75889 - DNA, 15 bp, Homo sapiens
cccaggagctttcgg

SEQ ID NO: 75890 - DNA, 15 bp, Homo sapiens
ccaggagctttcgga

SEQ ID NO: 75891 - DNA, 15 bp, Homo sapiens
caggagctttcggaa

SEQ ID NO: 75892 - DNA, 15 bp, Homo sapiens
aggagctttcggaag

SEQ ID NO: 75893 - DNA, 15 bp, Homo sapiens
ggagctttcggaagg

SEQ ID NO: 75894 - DNA, 15 bp, Homo sapiens
gagctttcggaaggc

SEQ ID NO: 75895 - DNA, 15 bp, Homo sapiens
agctttcggaaggcc

SEQ ID NO: 75896 - DNA, 15 bp, Homo sapiens
gctttcggaaggccc

SEQ ID NO: 75897 - DNA, 15 bp, Homo sapiens
ctttcggaaggcccg

SEQ ID NO: 75898 - DNA, 15 bp, Homo sapiens
tttcggaaggcccgg

SEQ ID NO: 75899 - DNA, 15 bp, Homo sapiens
ttcggaaggcccggc

SEQ ID NO: 75900 - DNA, 15 bp, Homo sapiens
tcggaaggcccggcc

SEQ ID NO: 75901 - DNA, 15 bp, Homo sapiens
cggaaggcccggccc

SEQ ID NO: 75902 - DNA, 15 bp, Homo sapiens
ggaaggcccggcccc

SEQ ID NO: 75903 - DNA, 15 bp, Homo sapiens
gaaggcccggccccg

SEQ ID NO: 75904 - DNA, 15 bp, Homo sapiens
aaggcccggccccgg

SEQ ID NO: 75905 - DNA, 15 bp, Homo sapiens
aggcccggccccggc

SEQ ID NO: 75906 - DNA, 15 bp, Homo sapiens
ggcccggccccggcc

SEQ ID NO: 75907 - DNA, 15 bp, Homo sapiens
gcccggccccggccc

SEQ ID NO: 75908 - DNA, 15 bp, Homo sapiens
cccggccccggcccc

SEQ ID NO: 75909 - DNA, 15 bp, Homo sapiens
ccggccccggcccct

SEQ ID NO: 75910 - DNA, 15 bp, Homo sapiens
cggccccggcccctt

SEQ ID NO: 75911 - DNA, 15 bp, Homo sapiens
ggccccggccccttt

SEQ ID NO: 75912 - DNA, 15 bp, Homo sapiens
gccccggcccctttc

SEQ ID NO: 75913 - DNA, 15 bp, Homo sapiens
ccccggcccctttcc

SEQ ID NO: 75914 - DNA, 15 bp, Homo sapiens
cccggcccctttccg

SEQ ID NO: 75915 - DNA, 15 bp, Homo sapiens
ccggcccctttccga

SEQ ID NO: 75916 - DNA, 15 bp, Homo sapiens
cggcccctttccgag

SEQ ID NO: 75917 - DNA, 15 bp, Homo sapiens
ggcccctttccgagc

SEQ ID NO: 75918 - DNA, 15 bp, Homo sapiens
gcccctttccgagca

SEQ ID NO: 75919 - DNA, 15 bp, Homo sapiens
cccctttccgagcag

SEQ ID NO: 75920 - DNA, 15 bp, Homo sapiens
ccctttccgagcagc

SEQ ID NO: 75921 - DNA, 15 bp, Homo sapiens
cctttccgagcagcc

SEQ ID NO: 75922 - DNA, 15 bp, Homo sapiens
ctttccgagcagccc

SEQ ID NO: 75923 - DNA, 15 bp, Homo sapiens
tttccgagcagcccg

SEQ ID NO: 75924 - DNA, 15 bp, Homo sapiens
ttccgagcagcccgg

SEQ ID NO: 75925 - DNA, 15 bp, Homo sapiens
tccgagcagcccggg

SEQ ID NO: 75926 - DNA, 15 bp, Homo sapiens
ccgagcagcccgggc

SEQ ID NO: 75927 - DNA, 15 bp, Homo sapiens
cgagcagcccgggcc

SEQ ID NO: 75928 - DNA, 15 bp, Homo sapiens
gagcagcccgggcct

SEQ ID NO: 75929 - DNA, 15 bp, Homo sapiens
agcagcccgggcctc

SEQ ID NO: 75930 - DNA, 15 bp, Homo sapiens
gcagcccgggcctcc

SEQ ID NO: 75931 - DNA, 15 bp, Homo sapiens
cagcccgggcctccg

SEQ ID NO: 75932 - DNA, 15 bp, Homo sapiens
agcccgggcctccgc

SEQ ID NO: 75933 - DNA, 15 bp, Homo sapiens
gcccgggcctccgcc

SEQ ID NO: 75934 - DNA, 15 bp, Homo sapiens
cccgggcctccgccc

SEQ ID NO: 75935 - DNA, 15 bp, Homo sapiens
ccgggcctccgccct

SEQ ID NO: 75936 - DNA, 15 bp, Homo sapiens
cgggcctccgccctg

SEQ ID NO: 75937 - DNA, 15 bp, Homo sapiens
gggcctccgccctgc

SEQ ID NO: 75938 - DNA, 15 bp, Homo sapiens
ggcctccgccctgcc

SEQ ID NO: 75939 - DNA, 15 bp, Homo sapiens
gcctccgccctgccc

SEQ ID NO: 75940 - DNA, 15 bp, Homo sapiens
cctccgccctgccct

SEQ ID NO: 75941 - DNA, 15 bp, Homo sapiens
ctccgccctgccctc

SEQ ID NO: 75942 - DNA, 15 bp, Homo sapiens
tccgccctgccctct

SEQ ID NO: 75943 - DNA, 15 bp, Homo sapiens
ccgccctgccctctg

SEQ ID NO: 75944 - DNA, 15 bp, Homo sapiens
cgccctgccctctgt

SEQ ID NO: 75945 - DNA, 15 bp, Homo sapiens
gccctgccctctgtc

SEQ ID NO: 75946 - DNA, 15 bp, Homo sapiens
ccctgccctctgtcc

SEQ ID NO: 75947 - DNA, 15 bp, Homo sapiens
cctgccctctgtccc

SEQ ID NO: 75948 - DNA, 15 bp, Homo sapiens
ctgccctctgtcccc

SEQ ID NO: 75949 - DNA, 15 bp, Homo sapiens
tgccctctgtcccca

SEQ ID NO: 75950 - DNA, 15 bp, Homo sapiens
gccctctgtccccaa

SEQ ID NO: 75951 - DNA, 15 bp, Homo sapiens
ccctctgtccccaac

SEQ ID NO: 75952 - DNA, 15 bp, Homo sapiens
cctctgtccccaacg

SEQ ID NO: 75953 - DNA, 15 bp, Homo sapiens
ctctgtccccaacgc

SEQ ID NO: 75954 - DNA, 15 bp, Homo sapiens
tctgtccccaacgcc

SEQ ID NO: 75955 - DNA, 15 bp, Homo sapiens
ctgtccccaacgccg

SEQ ID NO: 75956 - DNA, 15 bp, Homo sapiens
tgtccccaacgccgg

SEQ ID NO: 75957 - DNA, 15 bp, Homo sapiens
gtccccaacgccggg

SEQ ID NO: 75958 - DNA, 15 bp, Homo sapiens
tccccaacgccggga

SEQ ID NO: 75959 - DNA, 15 bp, Homo sapiens
ccccaacgccgggag

SEQ ID NO: 75960 - DNA, 15 bp, Homo sapiens
cccaacgccgggagc

SEQ ID NO: 75961 - DNA, 15 bp, Homo sapiens
ccaacgccgggagcc

SEQ ID NO: 75962 - DNA, 15 bp, Homo sapiens
caacgccgggagccg

SEQ ID NO: 75963 - DNA, 15 bp, Homo sapiens
aacgccgggagccgc

SEQ ID NO: 75964 - DNA, 15 bp, Homo sapiens
acgccgggagccgcc

SEQ ID NO: 75965 - DNA, 15 bp, Homo sapiens
cgccgggagccgccg

SEQ ID NO: 75966 - DNA, 15 bp, Homo sapiens
gccgggagccgccgt

SEQ ID NO: 75967 - DNA, 15 bp, Homo sapiens
ccgggagccgccgtt

SEQ ID NO: 75968 - DNA, 15 bp, Homo sapiens
cgggagccgccgttc

SEQ ID NO: 75969 - DNA, 15 bp, Homo sapiens
gggagccgccgttcg

SEQ ID NO: 75970 - DNA, 15 bp, Homo sapiens
ggagccgccgttcgt

SEQ ID NO: 75971 - DNA, 15 bp, Homo sapiens
gagccgccgttcgtc

SEQ ID NO: 75972 - DNA, 15 bp, Homo sapiens
agccgccgttcgtcc

SEQ ID NO: 75973 - DNA, 15 bp, Homo sapiens
gccgccgttcgtcct

SEQ ID NO: 75974 - DNA, 15 bp, Homo sapiens
ccgccgttcgtcctc

SEQ ID NO: 75975 - DNA, 15 bp, Homo sapiens
cgccgttcgtcctcc

SEQ ID NO: 75976 - DNA, 15 bp, Homo sapiens
gccgttcgtcctcca

SEQ ID NO: 75977 - DNA, 15 bp, Homo sapiens
ccgttcgtcctccag

SEQ ID NO: 75978 - DNA, 15 bp, Homo sapiens
cgttcgtcctccaga

SEQ ID NO: 75979 - DNA, 15 bp, Homo sapiens
gttcgtcctccagag

SEQ ID NO: 75980 - DNA, 15 bp, Homo sapiens
ttcgtcctccagagc

SEQ ID NO: 75981 - DNA, 15 bp, Homo sapiens
tcgtcctccagagcc

SEQ ID NO: 75982 - DNA, 15 bp, Homo sapiens
cgtcctccagagccc

SEQ ID NO: 75983 - DNA, 15 bp, Homo sapiens
gtcctccagagcccc

SEQ ID NO: 75984 - DNA, 15 bp, Homo sapiens
tcctccagagccccg

SEQ ID NO: 75985 - DNA, 15 bp, Homo sapiens
cctccagagccccgc

SEQ ID NO: 75986 - DNA, 15 bp, Homo sapiens
ctccagagccccgcc

SEQ ID NO: 75987 - DNA, 15 bp, Homo sapiens
tccagagccccgccc

SEQ ID NO: 75988 - DNA, 15 bp, Homo sapiens
ccagagccccgcccg

SEQ ID NO: 75989 - DNA, 15 bp, Homo sapiens
cagagccccgcccgg

SEQ ID NO: 75990 - DNA, 15 bp, Homo sapiens
agagccccgcccggg

SEQ ID NO: 75991 - DNA, 15 bp, Homo sapiens
gagccccgcccgggc

SEQ ID NO: 75992 - DNA, 15 bp, Homo sapiens
agccccgcccgggcg

SEQ ID NO: 75993 - DNA, 15 bp, Homo sapiens
gccccgcccgggcga

SEQ ID NO: 75994 - DNA, 15 bp, Homo sapiens
ccccgcccgggcgag

SEQ ID NO: 75995 - DNA, 15 bp, Homo sapiens
cccgcccgggcgagc

SEQ ID NO: 75996 - DNA, 15 bp, Homo sapiens
ccgcccgggcgagcc

SEQ ID NO: 75997 - DNA, 15 bp, Homo sapiens
cgcccgggcgagccc

SEQ ID NO: 75998 - DNA, 15 bp, Homo sapiens
gcccgggcgagcccg

SEQ ID NO: 75999 - DNA, 15 bp, Homo sapiens
cccgggcgagcccgg

SEQ ID NO: 76000 - DNA, 15 bp, Homo sapiens
ccgggcgagcccggg

SEQ ID NO: 76001 - DNA, 15 bp, Homo sapiens
cgggcgagcccggga

SEQ ID NO: 76002 - DNA, 15 bp, Homo sapiens
gggcgagcccgggag

SEQ ID NO: 76003 - DNA, 15 bp, Homo sapiens
ggcgagcccgggagg

SEQ ID NO: 76004 - DNA, 15 bp, Homo sapiens
gcgagcccgggaggc

SEQ ID NO: 76005 - DNA, 15 bp, Homo sapiens
cgagcccgggaggcc

SEQ ID NO: 76006 - DNA, 15 bp, Homo sapiens
gagcccgggaggccg

SEQ ID NO: 76007 - DNA, 15 bp, Homo sapiens
agcccgggaggccga

SEQ ID NO: 76008 - DNA, 15 bp, Homo sapiens
gcccgggaggccgat

SEQ ID NO: 76009 - DNA, 15 bp, Homo sapiens
cccgggaggccgatc

SEQ ID NO: 76010 - DNA, 15 bp, Homo sapiens
ccgggaggccgatcg

SEQ ID NO: 76011 - DNA, 15 bp, Homo sapiens
cgggaggccgatcgc

SEQ ID NO: 76012 - DNA, 15 bp, Homo sapiens
gggaggccgatcgcc

SEQ ID NO: 76013 - DNA, 15 bp, Homo sapiens
ggaggccgatcgccg

SEQ ID NO: 76014 - DNA, 15 bp, Homo sapiens
gaggccgatcgccgc

SEQ ID NO: 76015 - DNA, 15 bp, Homo sapiens
aggccgatcgccgct

SEQ ID NO: 76016 - DNA, 15 bp, Homo sapiens
ggccgatcgccgctc

SEQ ID NO: 76017 - DNA, 15 bp, Homo sapiens
gccgatcgccgctcg

SEQ ID NO: 76018 - DNA, 15 bp, Homo sapiens
ccgatcgccgctcgc

SEQ ID NO: 76019 - DNA, 15 bp, Homo sapiens
cgatcgccgctcgcg

SEQ ID NO: 76020 - DNA, 15 bp, Homo sapiens
gatcgccgctcgcgg

SEQ ID NO: 76021 - DNA, 15 bp, Homo sapiens
atcgccgctcgcgga

SEQ ID NO: 76022 - DNA, 15 bp, Homo sapiens
tcgccgctcgcggaa

SEQ ID NO: 76023 - DNA, 15 bp, Homo sapiens
cgccgctcgcggaac

SEQ ID NO: 76024 - DNA, 15 bp, Homo sapiens
gccgctcgcggaacc

SEQ ID NO: 76025 - DNA, 15 bp, Homo sapiens
ccgctcgcggaaccc

SEQ ID NO: 76026 - DNA, 15 bp, Homo sapiens
cgctcgcggaacccg

SEQ ID NO: 76027 - DNA, 15 bp, Homo sapiens
gctcgcggaacccgc

SEQ ID NO: 76028 - DNA, 15 bp, Homo sapiens
ctcgcggaacccgcc

SEQ ID NO: 76029 - DNA, 15 bp, Homo sapiens
tcgcggaacccgccg

SEQ ID NO: 76030 - DNA, 15 bp, Homo sapiens
cgcggaacccgccgg

SEQ ID NO: 76031 - DNA, 15 bp, Homo sapiens
gcggaacccgccggg

SEQ ID NO: 76032 - DNA, 15 bp, Homo sapiens
cggaacccgccggga

SEQ ID NO: 76033 - DNA, 15 bp, Homo sapiens
ggaacccgccgggac

SEQ ID NO: 76034 - DNA, 15 bp, Homo sapiens
gaacccgccgggacc

SEQ ID NO: 76035 - DNA, 15 bp, Homo sapiens
aacccgccgggaccc

SEQ ID NO: 76036 - DNA, 15 bp, Homo sapiens
acccgccgggacccg

SEQ ID NO: 76037 - DNA, 15 bp, Homo sapiens
cccgccgggacccgg

SEQ ID NO: 76038 - DNA, 15 bp, Homo sapiens
ccgccgggacccggg

SEQ ID NO: 76039 - DNA, 15 bp, Homo sapiens
cgccgggacccgggc

SEQ ID NO: 76040 - DNA, 15 bp, Homo sapiens
gccgggacccgggcc

SEQ ID NO: 76041 - DNA, 15 bp, Homo sapiens
ccgggacccgggccc

SEQ ID NO: 76042 - DNA, 15 bp, Homo sapiens
cgggacccgggccct

SEQ ID NO: 76043 - DNA, 15 bp, Homo sapiens
gggacccgggccctc

SEQ ID NO: 76044 - DNA, 15 bp, Homo sapiens
ggacccgggccctcc

SEQ ID NO: 76045 - DNA, 15 bp, Homo sapiens
gacccgggccctccc

SEQ ID NO: 76046 - DNA, 15 bp, Homo sapiens
acccgggccctcccc

SEQ ID NO: 76047 - DNA, 15 bp, Homo sapiens
cccgggccctccccg

SEQ ID NO: 76048 - DNA, 15 bp, Homo sapiens
ccgggccctccccgg

SEQ ID NO: 76049 - DNA, 15 bp, Homo sapiens
cgggccctccccggc

SEQ ID NO: 76050 - DNA, 15 bp, Homo sapiens
gggccctccccggcg

SEQ ID NO: 76051 - DNA, 15 bp, Homo sapiens
ggccctccccggcgc

SEQ ID NO: 76052 - DNA, 15 bp, Homo sapiens
gccctccccggcgcg

SEQ ID NO: 76053 - DNA, 15 bp, Homo sapiens
ccctccccggcgcgg

SEQ ID NO: 76054 - DNA, 15 bp, Homo sapiens
cctccccggcgcggg

SEQ ID NO: 76055 - DNA, 15 bp, Homo sapiens
ctccccggcgcgggg

SEQ ID NO: 76056 - DNA, 15 bp, Homo sapiens
tccccggcgcggggc

SEQ ID NO: 76057 - DNA, 15 bp, Homo sapiens
ccccggcgcggggcg

SEQ ID NO: 76058 - DNA, 15 bp, Homo sapiens
cccggcgcggggcgc

SEQ ID NO: 76059 - DNA, 15 bp, Homo sapiens
ccggcgcggggcgcc

SEQ ID NO: 76060 - DNA, 15 bp, Homo sapiens
cggcgcggggcgccc

SEQ ID NO: 76061 - DNA, 15 bp, Homo sapiens
ggcgcggggcgcccc

SEQ ID NO: 76062 - DNA, 15 bp, Homo sapiens
gcgcggggcgccccc

SEQ ID NO: 76063 - DNA, 15 bp, Homo sapiens
cgcggggcgcccccg

SEQ ID NO: 76064 - DNA, 15 bp, Homo sapiens
gcggggcgcccccgt

SEQ ID NO: 76065 - DNA, 15 bp, Homo sapiens
cggggcgcccccgtg

SEQ ID NO: 76066 - DNA, 15 bp, Homo sapiens
ggggcgcccccgtgt

SEQ ID NO: 76067 - DNA, 15 bp, Homo sapiens
gggcgcccccgtgtg

SEQ ID NO: 76068 - DNA, 15 bp, Homo sapiens
ggcgcccccgtgtga

SEQ ID NO: 76069 - DNA, 15 bp, Homo sapiens
gcgcccccgtgtgac

SEQ ID NO: 76070 - DNA, 15 bp, Homo sapiens
cgcccccgtgtgacc

SEQ ID NO: 76071 - DNA, 15 bp, Homo sapiens
gcccccgtgtgaccc

SEQ ID NO: 76072 - DNA, 15 bp, Homo sapiens
cccccgtgtgaccca

SEQ ID NO: 76073 - DNA, 15 bp, Homo sapiens
ccccgtgtgacccag

SEQ ID NO: 76074 - DNA, 15 bp, Homo sapiens
cccgtgtgacccagc

SEQ ID NO: 76075 - DNA, 15 bp, Homo sapiens
ccgtgtgacccagcg

SEQ ID NO: 76076 - DNA, 15 bp, Homo sapiens
cgtgtgacccagcgc

SEQ ID NO: 76077 - DNA, 15 bp, Homo sapiens
gtgtgacccagcgcg

SEQ ID NO: 76078 - DNA, 15 bp, Homo sapiens
tgtgacccagcgcgc

SEQ ID NO: 76079 - DNA, 15 bp, Homo sapiens
gtgacccagcgcgcg

SEQ ID NO: 76080 - DNA, 15 bp, Homo sapiens
tgacccagcgcgcgg

SEQ ID NO: 76081 - DNA, 15 bp, Homo sapiens
gacccagcgcgcggc

SEQ ID NO: 76082 - DNA, 15 bp, Homo sapiens
acccagcgcgcggcc

SEQ ID NO: 76083 - DNA, 15 bp, Homo sapiens
cccagcgcgcggccg

SEQ ID NO: 76084 - DNA, 15 bp, Homo sapiens
ccagcgcgcggccgc

SEQ ID NO: 76085 - DNA, 15 bp, Homo sapiens
cagcgcgcggccgcg

SEQ ID NO: 76086 - DNA, 15 bp, Homo sapiens
agcgcgcggccgcgg

SEQ ID NO: 76087 - DNA, 15 bp, Homo sapiens
gcgcgcggccgcggc

SEQ ID NO: 76088 - DNA, 15 bp, Homo sapiens
cgcgcggccgcggcg

SEQ ID NO: 76089 - DNA, 15 bp, Homo sapiens
gcgcggccgcggcgc

SEQ ID NO: 76090 - DNA, 15 bp, Homo sapiens
cgcggccgcggcgcg

SEQ ID NO: 76091 - DNA, 15 bp, Homo sapiens
gcggccgcggcgcgc

SEQ ID NO: 76092 - DNA, 15 bp, Homo sapiens
cggccgcggcgcgca

SEQ ID NO: 76093 - DNA, 15 bp, Homo sapiens
ggccgcggcgcgcaa

SEQ ID NO: 76094 - DNA, 15 bp, Homo sapiens
gccgcggcgcgcaag

SEQ ID NO: 76095 - DNA, 15 bp, Homo sapiens
ccgcggcgcgcaaga

SEQ ID NO: 76096 - DNA, 15 bp, Homo sapiens
cgcggcgcgcaagat

SEQ ID NO: 76097 - DNA, 15 bp, Homo sapiens
gcggcgcgcaagatg

SEQ ID NO: 76098 - DNA, 15 bp, Homo sapiens
cggcgcgcaagatgg

SEQ ID NO: 76099 - DNA, 15 bp, Homo sapiens
ggcgcgcaagatggc

SEQ ID NO: 76100 - DNA, 15 bp, Homo sapiens
gcgcgcaagatggcg

SEQ ID NO: 76101 - DNA, 15 bp, Homo sapiens
cgcgcaagatggcgg

SEQ ID NO: 76102 - DNA, 15 bp, Homo sapiens
gcgcaagatggcggc

SEQ ID NO: 76103 - DNA, 15 bp, Homo sapiens
cgcaagatggcggcg

SEQ ID NO: 76104 - DNA, 15 bp, Homo sapiens
gcaagatggcggcgg

SEQ ID NO: 76105 - DNA, 15 bp, Homo sapiens
caagatggcggcggg

SEQ ID NO: 76106 - DNA, 15 bp, Homo sapiens
aagatggcggcgggc

SEQ ID NO: 76107 - DNA, 15 bp, Homo sapiens
agatggcggcgggcc

SEQ ID NO: 76108 - DNA, 15 bp, Homo sapiens
gatggcggcgggccc

SEQ ID NO: 76109 - DNA, 15 bp, Homo sapiens
atggcggcgggcccg

SEQ ID NO: 76110 - DNA, 15 bp, Homo sapiens
tggcggcgggcccgg

SEQ ID NO: 76111 - DNA, 15 bp, Homo sapiens
ggcggcgggcccggg

SEQ ID NO: 76112 - DNA, 15 bp, Homo sapiens
gcggcgggcccgggc

SEQ ID NO: 76113 - DNA, 15 bp, Homo sapiens
cggcgggcccgggca

SEQ ID NO: 76114 - DNA, 15 bp, Homo sapiens
ggcgggcccgggcac

SEQ ID NO: 76115 - DNA, 15 bp, Homo sapiens
gcgggcccgggcacc

SEQ ID NO: 76116 - DNA, 15 bp, Homo sapiens
cgggcccgggcaccg

SEQ ID NO: 76117 - DNA, 15 bp, Homo sapiens
gggcccgggcaccgc

SEQ ID NO: 76118 - DNA, 15 bp, Homo sapiens
ggcccgggcaccgcc

SEQ ID NO: 76119 - DNA, 15 bp, Homo sapiens
gcccgggcaccgccc

SEQ ID NO: 76120 - DNA, 15 bp, Homo sapiens
cccgggcaccgcccc

SEQ ID NO: 76121 - DNA, 15 bp, Homo sapiens
ccgggcaccgcccct

SEQ ID NO: 76122 - DNA, 15 bp, Homo sapiens
cgggcaccgcccctt

SEQ ID NO: 76123 - DNA, 15 bp, Homo sapiens
gggcaccgccccttc

SEQ ID NO: 76124 - DNA, 15 bp, Homo sapiens
ggcaccgccccttcc

SEQ ID NO: 76125 - DNA, 15 bp, Homo sapiens
gcaccgccccttccg

SEQ ID NO: 76126 - DNA, 15 bp, Homo sapiens
caccgccccttccgc

SEQ ID NO: 76127 - DNA, 15 bp, Homo sapiens
accgccccttccgcc

SEQ ID NO: 76128 - DNA, 15 bp, Homo sapiens
ccgccccttccgccc

SEQ ID NO: 76129 - DNA, 15 bp, Homo sapiens
cgccccttccgcccc

SEQ ID NO: 76130 - DNA, 15 bp, Homo sapiens
gccccttccgccccg

SEQ ID NO: 76131 - DNA, 15 bp, Homo sapiens
ccccttccgccccgc

SEQ ID NO: 76132 - DNA, 15 bp, Homo sapiens
cccttccgccccgcc

SEQ ID NO: 76133 - DNA, 15 bp, Homo sapiens
ccttccgccccgccg

SEQ ID NO: 76134 - DNA, 15 bp, Homo sapiens
cttccgccccgccgg

SEQ ID NO: 76135 - DNA, 15 bp, Homo sapiens
ttccgccccgccggg

SEQ ID NO: 76136 - DNA, 15 bp, Homo sapiens
tccgccccgccgggc

SEQ ID NO: 76137 - DNA, 15 bp, Homo sapiens
ccgccccgccgggcg

SEQ ID NO: 76138 - DNA, 15 bp, Homo sapiens
cgccccgccgggcgt

SEQ ID NO: 76139 - DNA, 15 bp, Homo sapiens
gccccgccgggcgtc

SEQ ID NO: 76140 - DNA, 15 bp, Homo sapiens
ccccgccgggcgtcg

SEQ ID NO: 76141 - DNA, 15 bp, Homo sapiens
cccgccgggcgtcgc

SEQ ID NO: 76142 - DNA, 15 bp, Homo sapiens
ccgccgggcgtcgca

SEQ ID NO: 76143 - DNA, 15 bp, Homo sapiens
cgccgggcgtcgcac

SEQ ID NO: 76144 - DNA, 15 bp, Homo sapiens
gccgggcgtcgcacg

SEQ ID NO: 76145 - DNA, 15 bp, Homo sapiens
ccgggcgtcgcacga

SEQ ID NO: 76146 - DNA, 15 bp, Homo sapiens
cgggcgtcgcacgag

SEQ ID NO: 76147 - DNA, 15 bp, Homo sapiens
gggcgtcgcacgagg

SEQ ID NO: 76148 - DNA, 15 bp, Homo sapiens
ggcgtcgcacgaggc

SEQ ID NO: 76149 - DNA, 15 bp, Homo sapiens
gcgtcgcacgaggcc

SEQ ID NO: 76150 - DNA, 15 bp, Homo sapiens
cgtcgcacgaggccg

SEQ ID NO: 76151 - DNA, 15 bp, Homo sapiens
gtcgcacgaggccgg

SEQ ID NO: 76152 - DNA, 15 bp, Homo sapiens
tcgcacgaggccggc

SEQ ID NO: 76153 - DNA, 15 bp, Homo sapiens
cgcacgaggccggct

SEQ ID NO: 76154 - DNA, 15 bp, Homo sapiens
gcacgaggccggctc

SEQ ID NO: 76155 - DNA, 15 bp, Homo sapiens
cacgaggccggctcg

SEQ ID NO: 76156 - DNA, 15 bp, Homo sapiens
acgaggccggctcga

SEQ ID NO: 76157 - DNA, 15 bp, Homo sapiens
cgaggccggctcgaa

SEQ ID NO: 76158 - DNA, 15 bp, Homo sapiens
gaggccggctcgaag

SEQ ID NO: 76159 - DNA, 15 bp, Homo sapiens
aggccggctcgaagg

SEQ ID NO: 76160 - DNA, 15 bp, Homo sapiens
ggccggctcgaaggg

SEQ ID NO: 76161 - DNA, 15 bp, Homo sapiens
gccggctcgaagggg

SEQ ID NO: 76162 - DNA, 15 bp, Homo sapiens
ccggctcgaagggga

SEQ ID NO: 76163 - DNA, 15 bp, Homo sapiens
cggctcgaaggggaa

SEQ ID NO: 76164 - DNA, 15 bp, Homo sapiens
ggctcgaaggggaag

SEQ ID NO: 76165 - DNA, 15 bp, Homo sapiens
gctcgaaggggaagt

SEQ ID NO: 76166 - DNA, 15 bp, Homo sapiens
ctcgaaggggaagtg

SEQ ID NO: 76167 - DNA, 15 bp, Homo sapiens
tcgaaggggaagtga

SEQ ID NO: 76168 - DNA, 15 bp, Homo sapiens
cgaaggggaagtgag

SEQ ID NO: 76169 - DNA, 15 bp, Homo sapiens
gaaggggaagtgagt

SEQ ID NO: 76170 - DNA, 15 bp, Homo sapiens
aaggggaagtgagtc

SEQ ID NO: 76171 - DNA, 15 bp, Homo sapiens
aggggaagtgagtca

SEQ ID NO: 76172 - DNA, 15 bp, Homo sapiens
ggggaagtgagtcag

SEQ ID NO: 76173 - DNA, 15 bp, Homo sapiens
gggaagtgagtcagt

SEQ ID NO: 76174 - DNA, 15 bp, Homo sapiens
ggaagtgagtcagtg

SEQ ID NO: 76175 - DNA, 15 bp, Homo sapiens
gaagtgagtcagtgt

SEQ ID NO: 76176 - DNA, 15 bp, Homo sapiens
aagtgagtcagtgtc

SEQ ID NO: 76177 - DNA, 15 bp, Homo sapiens
agtgagtcagtgtcc

SEQ ID NO: 76178 - DNA, 15 bp, Homo sapiens
gtgagtcagtgtccg

SEQ ID NO: 76179 - DNA, 15 bp, Homo sapiens
tgagtcagtgtccgc

SEQ ID NO: 76180 - DNA, 15 bp, Homo sapiens
gagtcagtgtccgcg

SEQ ID NO: 76181 - DNA, 15 bp, Homo sapiens
agtcagtgtccgcgg

SEQ ID NO: 76182 - DNA, 15 bp, Homo sapiens
gtcagtgtccgcgga

SEQ ID NO: 76183 - DNA, 15 bp, Homo sapiens
tcagtgtccgcggac

SEQ ID NO: 76184 - DNA, 15 bp, Homo sapiens
cagtgtccgcggacc

SEQ ID NO: 76185 - DNA, 15 bp, Homo sapiens
agtgtccgcggaccc

SEQ ID NO: 76186 - DNA, 15 bp, Homo sapiens
gtgtccgcggacccg

SEQ ID NO: 76187 - DNA, 15 bp, Homo sapiens
tgtccgcggacccgg

SEQ ID NO: 76188 - DNA, 15 bp, Homo sapiens
gtccgcggacccggc

SEQ ID NO: 76189 - DNA, 15 bp, Homo sapiens
tccgcggacccggcc

SEQ ID NO: 76190 - DNA, 15 bp, Homo sapiens
ccgcggacccggccg

SEQ ID NO: 76191 - DNA, 15 bp, Homo sapiens
cgcggacccggccgg

SEQ ID NO: 76192 - DNA, 15 bp, Homo sapiens
gcggacccggccggc

SEQ ID NO: 76193 - DNA, 15 bp, Homo sapiens
cggacccggccggcc

SEQ ID NO: 76194 - DNA, 15 bp, Homo sapiens
ggacccggccggccc

SEQ ID NO: 76195 - DNA, 15 bp, Homo sapiens
gacccggccggccca

SEQ ID NO: 76196 - DNA, 15 bp, Homo sapiens
acccggccggcccag

SEQ ID NO: 76197 - DNA, 15 bp, Homo sapiens
cccggccggcccagg

SEQ ID NO: 76198 - DNA, 15 bp, Homo sapiens
ccggccggcccaggc

SEQ ID NO: 76199 - DNA, 15 bp, Homo sapiens
cggccggcccaggcc

SEQ ID NO: 76200 - DNA, 15 bp, Homo sapiens
ggccggcccaggccc

SEQ ID NO: 76201 - DNA, 15 bp, Homo sapiens
gccggcccaggcccg

SEQ ID NO: 76202 - DNA, 15 bp, Homo sapiens
ccggcccaggcccgc

SEQ ID NO: 76203 - DNA, 15 bp, Homo sapiens
cggcccaggcccgcg

SEQ ID NO: 76204 - DNA, 15 bp, Homo sapiens
ggcccaggcccgcgc

SEQ ID NO: 76205 - DNA, 15 bp, Homo sapiens
gcccaggcccgcgcc

SEQ ID NO: 76206 - DNA, 15 bp, Homo sapiens
cccaggcccgcgccc

SEQ ID NO: 76207 - DNA, 15 bp, Homo sapiens
ccaggcccgcgcccg

SEQ ID NO: 76208 - DNA, 15 bp, Homo sapiens
caggcccgcgcccgc

SEQ ID NO: 76209 - DNA, 15 bp, Homo sapiens
aggcccgcgcccgcc

SEQ ID NO: 76210 - DNA, 15 bp, Homo sapiens
ggcccgcgcccgccg

SEQ ID NO: 76211 - DNA, 15 bp, Homo sapiens
gcccgcgcccgccgc

SEQ ID NO: 76212 - DNA, 15 bp, Homo sapiens
cccgcgcccgccgcg

SEQ ID NO: 76213 - DNA, 15 bp, Homo sapiens
ccgcgcccgccgcgg

SEQ ID NO: 76214 - DNA, 15 bp, Homo sapiens
cgcgcccgccgcggc

SEQ ID NO: 76215 - DNA, 15 bp, Homo sapiens
gcgcccgccgcggcc

SEQ ID NO: 76216 - DNA, 15 bp, Homo sapiens
cgcccgccgcggccc

SEQ ID NO: 76217 - DNA, 15 bp, Homo sapiens
gcccgccgcggccct

SEQ ID NO: 76218 - DNA, 15 bp, Homo sapiens
cccgccgcggccctg

SEQ ID NO: 76219 - DNA, 15 bp, Homo sapiens
ccgccgcggccctga

SEQ ID NO: 76220 - DNA, 15 bp, Homo sapiens
cgccgcggccctgag

SEQ ID NO: 76221 - DNA, 15 bp, Homo sapiens
gccgcggccctgaga

SEQ ID NO: 76222 - DNA, 15 bp, Homo sapiens
ccgcggccctgagag

SEQ ID NO: 76223 - DNA, 15 bp, Homo sapiens
cgcggccctgagagg

SEQ ID NO: 76224 - DNA, 15 bp, Homo sapiens
gcggccctgagaggc

SEQ ID NO: 76225 - DNA, 15 bp, Homo sapiens
cggccctgagaggcc

SEQ ID NO: 76226 - DNA, 15 bp, Homo sapiens
ggccctgagaggccc

SEQ ID NO: 76227 - DNA, 15 bp, Homo sapiens
gccctgagaggcccc

SEQ ID NO: 76228 - DNA, 15 bp, Homo sapiens
ccctgagaggccccg

SEQ ID NO: 76229 - DNA, 15 bp, Homo sapiens
cctgagaggccccgg

SEQ ID NO: 76230 - DNA, 15 bp, Homo sapiens
ctgagaggccccggc

SEQ ID NO: 76231 - DNA, 15 bp, Homo sapiens
tgagaggccccggca

SEQ ID NO: 76232 - DNA, 15 bp, Homo sapiens
gagaggccccggcag

SEQ ID NO: 76233 - DNA, 15 bp, Homo sapiens
agaggccccggcagg

SEQ ID NO: 76234 - DNA, 15 bp, Homo sapiens
gaggccccggcaggt

SEQ ID NO: 76235 - DNA, 15 bp, Homo sapiens
aggccccggcaggtc

SEQ ID NO: 76236 - DNA, 15 bp, Homo sapiens
ggccccggcaggtcc

SEQ ID NO: 76237 - DNA, 15 bp, Homo sapiens
gccccggcaggtccc

SEQ ID NO: 76238 - DNA, 15 bp, Homo sapiens
ccccggcaggtcccg

SEQ ID NO: 76239 - DNA, 15 bp, Homo sapiens
cccggcaggtcccgg

SEQ ID NO: 76240 - DNA, 15 bp, Homo sapiens
ccggcaggtcccggc

SEQ ID NO: 76241 - DNA, 15 bp, Homo sapiens
cggcaggtcccggcc

SEQ ID NO: 76242 - DNA, 15 bp, Homo sapiens
ggcaggtcccggccc

SEQ ID NO: 76243 - DNA, 15 bp, Homo sapiens
gcaggtcccggcccg

SEQ ID NO: 76244 - DNA, 15 bp, Homo sapiens
caggtcccggcccgg

SEQ ID NO: 76245 - DNA, 15 bp, Homo sapiens
aggtcccggcccggc

SEQ ID NO: 76246 - DNA, 15 bp, Homo sapiens
ggtcccggcccggcg

SEQ ID NO: 76247 - DNA, 15 bp, Homo sapiens
gtcccggcccggcgg

SEQ ID NO: 76248 - DNA, 15 bp, Homo sapiens
tcccggcccggcggc

SEQ ID NO: 76249 - DNA, 15 bp, Homo sapiens
cccggcccggcggcg

SEQ ID NO: 76250 - DNA, 15 bp, Homo sapiens
ccggcccggcggcgg

SEQ ID NO: 76251 - DNA, 15 bp, Homo sapiens
cggcccggcggcggc

SEQ ID NO: 76252 - DNA, 15 bp, Homo sapiens
ggcccggcggcggca

SEQ ID NO: 76253 - DNA, 15 bp, Homo sapiens
gcccggcggcggcag

SEQ ID NO: 76254 - DNA, 15 bp, Homo sapiens
cccggcggcggcagc

SEQ ID NO: 76255 - DNA, 15 bp, Homo sapiens
ccggcggcggcagcc

SEQ ID NO: 76256 - DNA, 15 bp, Homo sapiens
cggcggcggcagcca

SEQ ID NO: 76257 - DNA, 15 bp, Homo sapiens
ggcggcggcagccat

SEQ ID NO: 76258 - DNA, 15 bp, Homo sapiens
gcggcggcagccatg

SEQ ID NO: 76259 - DNA, 15 bp, Homo sapiens
cggcggcagccatgg

SEQ ID NO: 76260 - DNA, 15 bp, Homo sapiens
ggcggcagccatggc

SEQ ID NO: 76261 - DNA, 15 bp, Homo sapiens
gcggcagccatggcc

SEQ ID NO: 76262 - DNA, 15 bp, Homo sapiens
cggcagccatggccg

SEQ ID NO: 76263 - DNA, 15 bp, Homo sapiens
ggcagccatggccgg

SEQ ID NO: 76264 - DNA, 15 bp, Homo sapiens
gcagccatggccggg

SEQ ID NO: 76265 - DNA, 15 bp, Homo sapiens
cagccatggccgggg

SEQ ID NO: 76266 - DNA, 15 bp, Homo sapiens
agccatggccggggg

SEQ ID NO: 76267 - DNA, 15 bp, Homo sapiens
gccatggccgggggg

SEQ ID NO: 76268 - DNA, 15 bp, Homo sapiens
ccatggccggggggc

SEQ ID NO: 76269 - DNA, 15 bp, Homo sapiens
catggccggggggcc

SEQ ID NO: 76270 - DNA, 15 bp, Homo sapiens
atggccggggggccg

SEQ ID NO: 76271 - DNA, 15 bp, Homo sapiens
tggccggggggccgg

SEQ ID NO: 76272 - DNA, 15 bp, Homo sapiens
ggccggggggccggg

SEQ ID NO: 76273 - DNA, 15 bp, Homo sapiens
gccggggggccgggc

SEQ ID NO: 76274 - DNA, 15 bp, Homo sapiens
ccggggggccgggcc

SEQ ID NO: 76275 - DNA, 15 bp, Homo sapiens
cggggggccgggccc

SEQ ID NO: 76276 - DNA, 15 bp, Homo sapiens
ggggggccgggcccg

SEQ ID NO: 76277 - DNA, 15 bp, Homo sapiens
gggggccgggcccgg

SEQ ID NO: 76278 - DNA, 15 bp, Homo sapiens
ggggccgggcccggg

SEQ ID NO: 76279 - DNA, 15 bp, Homo sapiens
gggccgggcccgggg

SEQ ID NO: 76280 - DNA, 15 bp, Homo sapiens
ggccgggcccggggg

SEQ ID NO: 76281 - DNA, 15 bp, Homo sapiens
gccgggcccggggga

SEQ ID NO: 76282 - DNA, 15 bp, Homo sapiens
ccgggcccgggggag

SEQ ID NO: 76283 - DNA, 15 bp, Homo sapiens
cgggcccgggggagc

SEQ ID NO: 76284 - DNA, 15 bp, Homo sapiens
gggcccgggggagcc

SEQ ID NO: 76285 - DNA, 15 bp, Homo sapiens
ggcccgggggagccc

SEQ ID NO: 76286 - DNA, 15 bp, Homo sapiens
gcccgggggagcccg

SEQ ID NO: 76287 - DNA, 15 bp, Homo sapiens
cccgggggagcccgc

SEQ ID NO: 76288 - DNA, 15 bp, Homo sapiens
ccgggggagcccgca

SEQ ID NO: 76289 - DNA, 15 bp, Homo sapiens
cgggggagcccgcag

SEQ ID NO: 76290 - DNA, 15 bp, Homo sapiens
gggggagcccgcagc

SEQ ID NO: 76291 - DNA, 15 bp, Homo sapiens
ggggagcccgcagcc

SEQ ID NO: 76292 - DNA, 15 bp, Homo sapiens
gggagcccgcagccc

SEQ ID NO: 76293 - DNA, 15 bp, Homo sapiens
ggagcccgcagcccc

SEQ ID NO: 76294 - DNA, 15 bp, Homo sapiens
gagcccgcagccccc

SEQ ID NO: 76295 - DNA, 15 bp, Homo sapiens
agcccgcagcccccg

SEQ ID NO: 76296 - DNA, 15 bp, Homo sapiens
gcccgcagcccccgg

SEQ ID NO: 76297 - DNA, 15 bp, Homo sapiens
cccgcagcccccggc

SEQ ID NO: 76298 - DNA, 15 bp, Homo sapiens
ccgcagcccccggcg

SEQ ID NO: 76299 - DNA, 15 bp, Homo sapiens
cgcagcccccggcgc

SEQ ID NO: 76300 - DNA, 15 bp, Homo sapiens
gcagcccccggcgcc

SEQ ID NO: 76301 - DNA, 15 bp, Homo sapiens
cagcccccggcgccc

SEQ ID NO: 76302 - DNA, 15 bp, Homo sapiens
agcccccggcgccca

SEQ ID NO: 76303 - DNA, 15 bp, Homo sapiens
gcccccggcgcccag

SEQ ID NO: 76304 - DNA, 15 bp, Homo sapiens
cccccggcgcccagc

SEQ ID NO: 76305 - DNA, 15 bp, Homo sapiens
ccccggcgcccagca

SEQ ID NO: 76306 - DNA, 15 bp, Homo sapiens
cccggcgcccagcac

SEQ ID NO: 76307 - DNA, 15 bp, Homo sapiens
ccggcgcccagcact

SEQ ID NO: 76308 - DNA, 15 bp, Homo sapiens
cggcgcccagcactt

SEQ ID NO: 76309 - DNA, 15 bp, Homo sapiens
ggcgcccagcacttc

SEQ ID NO: 76310 - DNA, 15 bp, Homo sapiens
gcgcccagcacttct

SEQ ID NO: 76311 - DNA, 15 bp, Homo sapiens
cgcccagcacttctt

SEQ ID NO: 76312 - DNA, 15 bp, Homo sapiens
gcccagcacttcttg

SEQ ID NO: 76313 - DNA, 15 bp, Homo sapiens
cccagcacttcttgt

SEQ ID NO: 76314 - DNA, 15 bp, Homo sapiens
ccagcacttcttgta

SEQ ID NO: 76315 - DNA, 15 bp, Homo sapiens
cagcacttcttgtac

SEQ ID NO: 76316 - DNA, 15 bp, Homo sapiens
agcacttcttgtacg

SEQ ID NO: 76317 - DNA, 15 bp, Homo sapiens
gcacttcttgtacga

SEQ ID NO: 76318 - DNA, 15 bp, Homo sapiens
cacttcttgtacgag

SEQ ID NO: 76319 - DNA, 15 bp, Homo sapiens
acttcttgtacgagg

SEQ ID NO: 76320 - DNA, 15 bp, Homo sapiens
cttcttgtacgaggt

SEQ ID NO: 76321 - DNA, 15 bp, Homo sapiens
ttcttgtacgaggtg

SEQ ID NO: 76322 - DNA, 15 bp, Homo sapiens
tcttgtacgaggtgc

SEQ ID NO: 76323 - DNA, 15 bp, Homo sapiens
cttgtacgaggtgcc

SEQ ID NO: 76324 - DNA, 15 bp, Homo sapiens
ttgtacgaggtgccg

SEQ ID NO: 76325 - DNA, 15 bp, Homo sapiens
tgtacgaggtgccgc

SEQ ID NO: 76326 - DNA, 15 bp, Homo sapiens
gtacgaggtgccgcc

SEQ ID NO: 76327 - DNA, 15 bp, Homo sapiens
tacgaggtgccgccc

SEQ ID NO: 76328 - DNA, 15 bp, Homo sapiens
acgaggtgccgccct

SEQ ID NO: 76329 - DNA, 15 bp, Homo sapiens
cgaggtgccgccctg

SEQ ID NO: 76330 - DNA, 15 bp, Homo sapiens
gaggtgccgccctgg

SEQ ID NO: 76331 - DNA, 15 bp, Homo sapiens
aggtgccgccctggg

SEQ ID NO: 76332 - DNA, 15 bp, Homo sapiens
ggtgccgccctgggt

SEQ ID NO: 76333 - DNA, 15 bp, Homo sapiens
gtgccgccctgggtc

SEQ ID NO: 76334 - DNA, 15 bp, Homo sapiens
tgccgccctgggtca

SEQ ID NO: 76335 - DNA, 15 bp, Homo sapiens
gccgccctgggtcat

SEQ ID NO: 76336 - DNA, 15 bp, Homo sapiens
ccgccctgggtcatg

SEQ ID NO: 76337 - DNA, 15 bp, Homo sapiens
cgccctgggtcatgt

SEQ ID NO: 76338 - DNA, 15 bp, Homo sapiens
gccctgggtcatgtg

SEQ ID NO: 76339 - DNA, 15 bp, Homo sapiens
ccctgggtcatgtgc

SEQ ID NO: 76340 - DNA, 15 bp, Homo sapiens
cctgggtcatgtgcc

SEQ ID NO: 76341 - DNA, 15 bp, Homo sapiens
ctgggtcatgtgccg

SEQ ID NO: 76342 - DNA, 15 bp, Homo sapiens
tgggtcatgtgccgc

SEQ ID NO: 76343 - DNA, 15 bp, Homo sapiens
gggtcatgtgccgct

SEQ ID NO: 76344 - DNA, 15 bp, Homo sapiens
ggtcatgtgccgctt

SEQ ID NO: 76345 - DNA, 15 bp, Homo sapiens
gtcatgtgccgcttc

SEQ ID NO: 76346 - DNA, 15 bp, Homo sapiens
tcatgtgccgcttct

SEQ ID NO: 76347 - DNA, 15 bp, Homo sapiens
catgtgccgcttcta

SEQ ID NO: 76348 - DNA, 15 bp, Homo sapiens
atgtgccgcttctac

SEQ ID NO: 76349 - DNA, 15 bp, Homo sapiens
tgtgccgcttctaca

SEQ ID NO: 76350 - DNA, 15 bp, Homo sapiens
gtgccgcttctacaa

SEQ ID NO: 76351 - DNA, 15 bp, Homo sapiens
tgccgcttctacaaa

SEQ ID NO: 76352 - DNA, 15 bp, Homo sapiens
gccgcttctacaaag

SEQ ID NO: 76353 - DNA, 15 bp, Homo sapiens
ccgcttctacaaagt

SEQ ID NO: 76354 - DNA, 15 bp, Homo sapiens
cgcttctacaaagtg

SEQ ID NO: 76355 - DNA, 15 bp, Homo sapiens
gcttctacaaagtga

SEQ ID NO: 76356 - DNA, 15 bp, Homo sapiens
cttctacaaagtgat

SEQ ID NO: 76357 - DNA, 15 bp, Homo sapiens
ttctacaaagtgatg

SEQ ID NO: 76358 - DNA, 15 bp, Homo sapiens
tctacaaagtgatgg

SEQ ID NO: 76359 - DNA, 15 bp, Homo sapiens
ctacaaagtgatgga

SEQ ID NO: 76360 - DNA, 15 bp, Homo sapiens
tacaaagtgatggac

SEQ ID NO: 76361 - DNA, 15 bp, Homo sapiens
acaaagtgatggacg

SEQ ID NO: 76362 - DNA, 15 bp, Homo sapiens
caaagtgatggacgc

SEQ ID NO: 76363 - DNA, 15 bp, Homo sapiens
aaagtgatggacgcc

SEQ ID NO: 76364 - DNA, 15 bp, Homo sapiens
aagtgatggacgccc

SEQ ID NO: 76365 - DNA, 15 bp, Homo sapiens
agtgatggacgccct

SEQ ID NO: 76366 - DNA, 15 bp, Homo sapiens
gtgatggacgccctg

SEQ ID NO: 76367 - DNA, 15 bp, Homo sapiens
tgatggacgccctgg

SEQ ID NO: 76368 - DNA, 15 bp, Homo sapiens
gatggacgccctgga

SEQ ID NO: 76369 - DNA, 15 bp, Homo sapiens
atggacgccctggag

SEQ ID NO: 76370 - DNA, 15 bp, Homo sapiens
tggacgccctggagc

SEQ ID NO: 76371 - DNA, 15 bp, Homo sapiens
ggacgccctggagcc

SEQ ID NO: 76372 - DNA, 15 bp, Homo sapiens
gacgccctggagccc

SEQ ID NO: 76373 - DNA, 15 bp, Homo sapiens
acgccctggagcccg

SEQ ID NO: 76374 - DNA, 15 bp, Homo sapiens
cgccctggagcccgc

SEQ ID NO: 76375 - DNA, 15 bp, Homo sapiens
gccctggagcccgcc

SEQ ID NO: 76376 - DNA, 15 bp, Homo sapiens
ccctggagcccgccg

SEQ ID NO: 76377 - DNA, 15 bp, Homo sapiens
cctggagcccgccga

SEQ ID NO: 76378 - DNA, 15 bp, Homo sapiens
ctggagcccgccgac

SEQ ID NO: 76379 - DNA, 15 bp, Homo sapiens
tggagcccgccgact

SEQ ID NO: 76380 - DNA, 15 bp, Homo sapiens
ggagcccgccgactg

SEQ ID NO: 76381 - DNA, 15 bp, Homo sapiens
gagcccgccgactgg

SEQ ID NO: 76382 - DNA, 15 bp, Homo sapiens
agcccgccgactggt

SEQ ID NO: 76383 - DNA, 15 bp, Homo sapiens
gcccgccgactggtg

SEQ ID NO: 76384 - DNA, 15 bp, Homo sapiens
cccgccgactggtgc

SEQ ID NO: 76385 - DNA, 15 bp, Homo sapiens
ccgccgactggtgcc

SEQ ID NO: 76386 - DNA, 15 bp, Homo sapiens
cgccgactggtgcca

SEQ ID NO: 76387 - DNA, 15 bp, Homo sapiens
gccgactggtgccag

SEQ ID NO: 76388 - DNA, 15 bp, Homo sapiens
ccgactggtgccagt

SEQ ID NO: 76389 - DNA, 15 bp, Homo sapiens
cgactggtgccagtt

SEQ ID NO: 76390 - DNA, 15 bp, Homo sapiens
gactggtgccagttc

SEQ ID NO: 76391 - DNA, 15 bp, Homo sapiens
actggtgccagttcg

SEQ ID NO: 76392 - DNA, 15 bp, Homo sapiens
ctggtgccagttcgg

SEQ ID NO: 76393 - DNA, 15 bp, Homo sapiens
tggtgccagttcggt

SEQ ID NO: 76394 - DNA, 15 bp, Homo sapiens
ggtgccagttcggtg

SEQ ID NO: 76395 - DNA, 15 bp, Homo sapiens
gtgccagttcggtgg

SEQ ID NO: 76396 - DNA, 15 bp, Homo sapiens
tgccagttcggtggg

SEQ ID NO: 76397 - DNA, 15 bp, Homo sapiens
gccagttcggtgggt

SEQ ID NO: 76398 - DNA, 15 bp, Homo sapiens
ccagttcggtgggtg

SEQ ID NO: 76399 - DNA, 15 bp, Homo sapiens
cagttcggtgggtgg

SEQ ID NO: 76400 - DNA, 15 bp, Homo sapiens
agttcggtgggtggc

SEQ ID NO: 76401 - DNA, 15 bp, Homo sapiens
gttcggtgggtggcg

SEQ ID NO: 76402 - DNA, 15 bp, Homo sapiens
ttcggtgggtggcgg

SEQ ID NO: 76403 - DNA, 15 bp, Homo sapiens
tcggtgggtggcggc

SEQ ID NO: 76404 - DNA, 15 bp, Homo sapiens
cggtgggtggcggcg

SEQ ID NO: 76405 - DNA, 15 bp, Homo sapiens
ggtgggtggcggcgg

SEQ ID NO: 76406 - DNA, 15 bp, Homo sapiens
gtgggtggcggcggg

SEQ ID NO: 76407 - DNA, 15 bp, Homo sapiens
tgggtggcggcgggc

SEQ ID NO: 76408 - DNA, 15 bp, Homo sapiens
gggtggcggcgggct

SEQ ID NO: 76409 - DNA, 15 bp, Homo sapiens
ggtggcggcgggctg

SEQ ID NO: 76410 - DNA, 15 bp, Homo sapiens
gtggcggcgggctgc

SEQ ID NO: 76411 - DNA, 15 bp, Homo sapiens
tggcggcgggctgcc

SEQ ID NO: 76412 - DNA, 15 bp, Homo sapiens
ggcggcgggctgccg

SEQ ID NO: 76413 - DNA, 15 bp, Homo sapiens
gcggcgggctgccgg

SEQ ID NO: 76414 - DNA, 15 bp, Homo sapiens
cggcgggctgccggg

SEQ ID NO: 76415 - DNA, 15 bp, Homo sapiens
ggcgggctgccgggg

SEQ ID NO: 76416 - DNA, 15 bp, Homo sapiens
gcgggctgccggggg

SEQ ID NO: 76417 - DNA, 15 bp, Homo sapiens
cgggctgccgggggg

SEQ ID NO: 76418 - DNA, 15 bp, Homo sapiens
gggctgccggggggc

SEQ ID NO: 76419 - DNA, 15 bp, Homo sapiens
ggctgccggggggcg

SEQ ID NO: 76420 - DNA, 15 bp, Homo sapiens
gctgccggggggcgg

SEQ ID NO: 76421 - DNA, 15 bp, Homo sapiens
ctgccggggggcggg

SEQ ID NO: 76422 - DNA, 15 bp, Homo sapiens
tgccggggggcggga

SEQ ID NO: 76423 - DNA, 15 bp, Homo sapiens
gccggggggcgggag

SEQ ID NO: 76424 - DNA, 15 bp, Homo sapiens
ccggggggcgggagg

SEQ ID NO: 76425 - DNA, 15 bp, Homo sapiens
cggggggcgggaggc

SEQ ID NO: 76426 - DNA, 15 bp, Homo sapiens
ggggggcgggaggcg

SEQ ID NO: 76427 - DNA, 15 bp, Homo sapiens
gggggcgggaggcgc

SEQ ID NO: 76428 - DNA, 15 bp, Homo sapiens
ggggcgggaggcgcg

SEQ ID NO: 76429 - DNA, 15 bp, Homo sapiens
gggcgggaggcgcgc

SEQ ID NO: 76430 - DNA, 15 bp, Homo sapiens
ggcgggaggcgcgcg

SEQ ID NO: 76431 - DNA, 15 bp, Homo sapiens
gcgggaggcgcgcgg

SEQ ID NO: 76432 - DNA, 15 bp, Homo sapiens
cgggaggcgcgcggg

SEQ ID NO: 76433 - DNA, 15 bp, Homo sapiens
gggaggcgcgcgggc

SEQ ID NO: 76434 - DNA, 15 bp, Homo sapiens
ggaggcgcgcgggct

SEQ ID NO: 76435 - DNA, 15 bp, Homo sapiens
gaggcgcgcgggctc

SEQ ID NO: 76436 - DNA, 15 bp, Homo sapiens
aggcgcgcgggctcc

SEQ ID NO: 76437 - DNA, 15 bp, Homo sapiens
ggcgcgcgggctcct

SEQ ID NO: 76438 - DNA, 15 bp, Homo sapiens
gcgcgcgggctcctg

SEQ ID NO: 76439 - DNA, 15 bp, Homo sapiens
cgcgcgggctcctgg

SEQ ID NO: 76440 - DNA, 15 bp, Homo sapiens
gcgcgggctcctggc

SEQ ID NO: 76441 - DNA, 15 bp, Homo sapiens
cgcgggctcctggcg

SEQ ID NO: 76442 - DNA, 15 bp, Homo sapiens
gcgggctcctggcgc

SEQ ID NO: 76443 - DNA, 15 bp, Homo sapiens
cgggctcctggcgcc

SEQ ID NO: 76444 - DNA, 15 bp, Homo sapiens
gggctcctggcgccg

SEQ ID NO: 76445 - DNA, 15 bp, Homo sapiens
ggctcctggcgccga

SEQ ID NO: 76446 - DNA, 15 bp, Homo sapiens
gctcctggcgccgac

SEQ ID NO: 76447 - DNA, 15 bp, Homo sapiens
ctcctggcgccgacg

SEQ ID NO: 76448 - DNA, 15 bp, Homo sapiens
tcctggcgccgacgc

SEQ ID NO: 76449 - DNA, 15 bp, Homo sapiens
cctggcgccgacgcc

SEQ ID NO: 76450 - DNA, 15 bp, Homo sapiens
ctggcgccgacgcct

SEQ ID NO: 76451 - DNA, 15 bp, Homo sapiens
tggcgccgacgcctg

SEQ ID NO: 76452 - DNA, 15 bp, Homo sapiens
ggcgccgacgcctga

SEQ ID NO: 76453 - DNA, 15 bp, Homo sapiens
gcgccgacgcctgac

SEQ ID NO: 76454 - DNA, 15 bp, Homo sapiens
cgccgacgcctgacg

SEQ ID NO: 76455 - DNA, 15 bp, Homo sapiens
gccgacgcctgacgc

SEQ ID NO: 76456 - DNA, 15 bp, Homo sapiens
ccgacgcctgacgcc

SEQ ID NO: 76457 - DNA, 15 bp, Homo sapiens
cgacgcctgacgccc

SEQ ID NO: 76458 - DNA, 15 bp, Homo sapiens
gacgcctgacgcccc

SEQ ID NO: 76459 - DNA, 15 bp, Homo sapiens
acgcctgacgccccc

SEQ ID NO: 76460 - DNA, 15 bp, Homo sapiens
cgcctgacgcccccc

SEQ ID NO: 76461 - DNA, 15 bp, Homo sapiens
gcctgacgccccccg

SEQ ID NO: 76462 - DNA, 15 bp, Homo sapiens
cctgacgccccccgc

SEQ ID NO: 76463 - DNA, 15 bp, Homo sapiens
ctgacgccccccgcc

SEQ ID NO: 76464 - DNA, 15 bp, Homo sapiens
tgacgccccccgccc

SEQ ID NO: 76465 - DNA, 15 bp, Homo sapiens
gacgccccccgcccc

SEQ ID NO: 76466 - DNA, 15 bp, Homo sapiens
acgccccccgccccg

SEQ ID NO: 76467 - DNA, 15 bp, Homo sapiens
cgccccccgccccgc

SEQ ID NO: 76468 - DNA, 15 bp, Homo sapiens
gccccccgccccgca

SEQ ID NO: 76469 - DNA, 15 bp, Homo sapiens
ccccccgccccgcag

SEQ ID NO: 76470 - DNA, 15 bp, Homo sapiens
cccccgccccgcagc

SEQ ID NO: 76471 - DNA, 15 bp, Homo sapiens
ccccgccccgcagcc

SEQ ID NO: 76472 - DNA, 15 bp, Homo sapiens
cccgccccgcagccg

SEQ ID NO: 76473 - DNA, 15 bp, Homo sapiens
ccgccccgcagccgc

SEQ ID NO: 76474 - DNA, 15 bp, Homo sapiens
cgccccgcagccgcc

SEQ ID NO: 76475 - DNA, 15 bp, Homo sapiens
gccccgcagccgccc

SEQ ID NO: 76476 - DNA, 15 bp, Homo sapiens
ccccgcagccgccct

SEQ ID NO: 76477 - DNA, 15 bp, Homo sapiens
cccgcagccgccctg

SEQ ID NO: 76478 - DNA, 15 bp, Homo sapiens
ccgcagccgccctga

SEQ ID NO: 76479 - DNA, 15 bp, Homo sapiens
cgcagccgccctgat

SEQ ID NO: 76480 - DNA, 15 bp, Homo sapiens
gcagccgccctgatc

SEQ ID NO: 76481 - DNA, 15 bp, Homo sapiens
cagccgccctgatcg

SEQ ID NO: 76482 - DNA, 15 bp, Homo sapiens
agccgccctgatcgt

SEQ ID NO: 76483 - DNA, 15 bp, Homo sapiens
gccgccctgatcgtg

SEQ ID NO: 76484 - DNA, 15 bp, Homo sapiens
ccgccctgatcgtgc

SEQ ID NO: 76485 - DNA, 15 bp, Homo sapiens
cgccctgatcgtgcg

SEQ ID NO: 76486 - DNA, 15 bp, Homo sapiens
gccctgatcgtgcgc

SEQ ID NO: 76487 - DNA, 15 bp, Homo sapiens
ccctgatcgtgcgcg

SEQ ID NO: 76488 - DNA, 15 bp, Homo sapiens
cctgatcgtgcgcga

SEQ ID NO: 76489 - DNA, 15 bp, Homo sapiens
ctgatcgtgcgcgac

SEQ ID NO: 76490 - DNA, 15 bp, Homo sapiens
tgatcgtgcgcgacc

SEQ ID NO: 76491 - DNA, 15 bp, Homo sapiens
gatcgtgcgcgacca

SEQ ID NO: 76492 - DNA, 15 bp, Homo sapiens
atcgtgcgcgaccag

SEQ ID NO: 76493 - DNA, 15 bp, Homo sapiens
tcgtgcgcgaccaga

SEQ ID NO: 76494 - DNA, 15 bp, Homo sapiens
cgtgcgcgaccagac

SEQ ID NO: 76495 - DNA, 15 bp, Homo sapiens
gtgcgcgaccagacc

SEQ ID NO: 76496 - DNA, 15 bp, Homo sapiens
tgcgcgaccagaccg

SEQ ID NO: 76497 - DNA, 15 bp, Homo sapiens
gcgcgaccagaccga

SEQ ID NO: 76498 - DNA, 15 bp, Homo sapiens
cgcgaccagaccgag

SEQ ID NO: 76499 - DNA, 15 bp, Homo sapiens
gcgaccagaccgagc

SEQ ID NO: 76500 - DNA, 15 bp, Homo sapiens
cgaccagaccgagct

SEQ ID NO: 76501 - DNA, 15 bp, Homo sapiens
gaccagaccgagctg

SEQ ID NO: 76502 - DNA, 15 bp, Homo sapiens
accagaccgagctgc

SEQ ID NO: 76503 - DNA, 15 bp, Homo sapiens
ccagaccgagctgcg

SEQ ID NO: 76504 - DNA, 15 bp, Homo sapiens
cagaccgagctgcgg

SEQ ID NO: 76505 - DNA, 15 bp, Homo sapiens
agaccgagctgcggc

SEQ ID NO: 76506 - DNA, 15 bp, Homo sapiens
gaccgagctgcggct

SEQ ID NO: 76507 - DNA, 15 bp, Homo sapiens
accgagctgcggctg

SEQ ID NO: 76508 - DNA, 15 bp, Homo sapiens
ccgagctgcggctgt

SEQ ID NO: 76509 - DNA, 15 bp, Homo sapiens
cgagctgcggctgtg

SEQ ID NO: 76510 - DNA, 15 bp, Homo sapiens
gagctgcggctgtgc

SEQ ID NO: 76511 - DNA, 15 bp, Homo sapiens
agctgcggctgtgcg

SEQ ID NO: 76512 - DNA, 15 bp, Homo sapiens
gctgcggctgtgcga

SEQ ID NO: 76513 - DNA, 15 bp, Homo sapiens
ctgcggctgtgcgag

SEQ ID NO: 76514 - DNA, 15 bp, Homo sapiens
tgcggctgtgcgagc

SEQ ID NO: 76515 - DNA, 15 bp, Homo sapiens
gcggctgtgcgagcg

SEQ ID NO: 76516 - DNA, 15 bp, Homo sapiens
cggctgtgcgagcgc

SEQ ID NO: 76517 - DNA, 15 bp, Homo sapiens
ggctgtgcgagcgct

SEQ ID NO: 76518 - DNA, 15 bp, Homo sapiens
gctgtgcgagcgctc

SEQ ID NO: 76519 - DNA, 15 bp, Homo sapiens
ctgtgcgagcgctcc

SEQ ID NO: 76520 - DNA, 15 bp, Homo sapiens
tgtgcgagcgctccg

SEQ ID NO: 76521 - DNA, 15 bp, Homo sapiens
gtgcgagcgctccgg

SEQ ID NO: 76522 - DNA, 15 bp, Homo sapiens
tgcgagcgctccggg

SEQ ID NO: 76523 - DNA, 15 bp, Homo sapiens
gcgagcgctccgggc

SEQ ID NO: 76524 - DNA, 15 bp, Homo sapiens
cgagcgctccgggca

SEQ ID NO: 76525 - DNA, 15 bp, Homo sapiens
gagcgctccgggcag

SEQ ID NO: 76526 - DNA, 15 bp, Homo sapiens
agcgctccgggcagc

SEQ ID NO: 76527 - DNA, 15 bp, Homo sapiens
gcgctccgggcagcg

SEQ ID NO: 76528 - DNA, 15 bp, Homo sapiens
cgctccgggcagcgc

SEQ ID NO: 76529 - DNA, 15 bp, Homo sapiens
gctccgggcagcgca

SEQ ID NO: 76530 - DNA, 15 bp, Homo sapiens
ctccgggcagcgcac

SEQ ID NO: 76531 - DNA, 15 bp, Homo sapiens
tccgggcagcgcacg

SEQ ID NO: 76532 - DNA, 15 bp, Homo sapiens
ccgggcagcgcacgg

SEQ ID NO: 76533 - DNA, 15 bp, Homo sapiens
cgggcagcgcacggc

SEQ ID NO: 76534 - DNA, 15 bp, Homo sapiens
gggcagcgcacggcc

SEQ ID NO: 76535 - DNA, 15 bp, Homo sapiens
ggcagcgcacggcca

SEQ ID NO: 76536 - DNA, 15 bp, Homo sapiens
gcagcgcacggccag

SEQ ID NO: 76537 - DNA, 15 bp, Homo sapiens
cagcgcacggccagc

SEQ ID NO: 76538 - DNA, 15 bp, Homo sapiens
agcgcacggccagcg

SEQ ID NO: 76539 - DNA, 15 bp, Homo sapiens
gcgcacggccagcgt

SEQ ID NO: 76540 - DNA, 15 bp, Homo sapiens
cgcacggccagcgtc

SEQ ID NO: 76541 - DNA, 15 bp, Homo sapiens
gcacggccagcgtcc

SEQ ID NO: 76542 - DNA, 15 bp, Homo sapiens
cacggccagcgtcct

SEQ ID NO: 76543 - DNA, 15 bp, Homo sapiens
acggccagcgtcctg

SEQ ID NO: 76544 - DNA, 15 bp, Homo sapiens
cggccagcgtcctgt

SEQ ID NO: 76545 - DNA, 15 bp, Homo sapiens
ggccagcgtcctgtg

SEQ ID NO: 76546 - DNA, 15 bp, Homo sapiens
gccagcgtcctgtgg

SEQ ID NO: 76547 - DNA, 15 bp, Homo sapiens
ccagcgtcctgtggc

SEQ ID NO: 76548 - DNA, 15 bp, Homo sapiens
cagcgtcctgtggcc

SEQ ID NO: 76549 - DNA, 15 bp, Homo sapiens
agcgtcctgtggccc

SEQ ID NO: 76550 - DNA, 15 bp, Homo sapiens
gcgtcctgtggccct

SEQ ID NO: 76551 - DNA, 15 bp, Homo sapiens
cgtcctgtggccctg

SEQ ID NO: 76552 - DNA, 15 bp, Homo sapiens
gtcctgtggccctgg

SEQ ID NO: 76553 - DNA, 15 bp, Homo sapiens
tcctgtggccctgga

SEQ ID NO: 76554 - DNA, 15 bp, Homo sapiens
cctgtggccctggat

SEQ ID NO: 76555 - DNA, 15 bp, Homo sapiens
ctgtggccctggatc

SEQ ID NO: 76556 - DNA, 15 bp, Homo sapiens
tgtggccctggatca

SEQ ID NO: 76557 - DNA, 15 bp, Homo sapiens
gtggccctggatcaa

SEQ ID NO: 76558 - DNA, 15 bp, Homo sapiens
tggccctggatcaac

SEQ ID NO: 76559 - DNA, 15 bp, Homo sapiens
ggccctggatcaacc

SEQ ID NO: 76560 - DNA, 15 bp, Homo sapiens
gccctggatcaaccg

SEQ ID NO: 76561 - DNA, 15 bp, Homo sapiens
ccctggatcaaccgc

SEQ ID NO: 76562 - DNA, 15 bp, Homo sapiens
cctggatcaaccgca

SEQ ID NO: 76563 - DNA, 15 bp, Homo sapiens
ctggatcaaccgcaa

SEQ ID NO: 76564 - DNA, 15 bp, Homo sapiens
tggatcaaccgcaac

SEQ ID NO: 76565 - DNA, 15 bp, Homo sapiens
ggatcaaccgcaacg

SEQ ID NO: 76566 - DNA, 15 bp, Homo sapiens
gatcaaccgcaacgc

SEQ ID NO: 76567 - DNA, 15 bp, Homo sapiens
atcaaccgcaacgcc

SEQ ID NO: 76568 - DNA, 15 bp, Homo sapiens
tcaaccgcaacgccc

SEQ ID NO: 76569 - DNA, 15 bp, Homo sapiens
caaccgcaacgcccg

SEQ ID NO: 76570 - DNA, 15 bp, Homo sapiens
aaccgcaacgcccgt

SEQ ID NO: 76571 - DNA, 15 bp, Homo sapiens
accgcaacgcccgtg

SEQ ID NO: 76572 - DNA, 15 bp, Homo sapiens
ccgcaacgcccgtgt

SEQ ID NO: 76573 - DNA, 15 bp, Homo sapiens
cgcaacgcccgtgtg

SEQ ID NO: 76574 - DNA, 15 bp, Homo sapiens
gcaacgcccgtgtgg

SEQ ID NO: 76575 - DNA, 15 bp, Homo sapiens
caacgcccgtgtggc

SEQ ID NO: 76576 - DNA, 15 bp, Homo sapiens
aacgcccgtgtggcc

SEQ ID NO: 76577 - DNA, 15 bp, Homo sapiens
acgcccgtgtggccg

SEQ ID NO: 76578 - DNA, 15 bp, Homo sapiens
cgcccgtgtggccga

SEQ ID NO: 76579 - DNA, 15 bp, Homo sapiens
gcccgtgtggccgac

SEQ ID NO: 76580 - DNA, 15 bp, Homo sapiens
cccgtgtggccgacc

SEQ ID NO: 76581 - DNA, 15 bp, Homo sapiens
ccgtgtggccgacct

SEQ ID NO: 76582 - DNA, 15 bp, Homo sapiens
cgtgtggccgacctc

SEQ ID NO: 76583 - DNA, 15 bp, Homo sapiens
gtgtggccgacctcg

SEQ ID NO: 76584 - DNA, 15 bp, Homo sapiens
tgtggccgacctcgt

SEQ ID NO: 76585 - DNA, 15 bp, Homo sapiens
gtggccgacctcgtg

SEQ ID NO: 76586 - DNA, 15 bp, Homo sapiens
tggccgacctcgtgc

SEQ ID NO: 76587 - DNA, 15 bp, Homo sapiens
ggccgacctcgtgca

SEQ ID NO: 76588 - DNA, 15 bp, Homo sapiens
gccgacctcgtgcac

SEQ ID NO: 76589 - DNA, 15 bp, Homo sapiens
ccgacctcgtgcaca

SEQ ID NO: 76590 - DNA, 15 bp, Homo sapiens
cgacctcgtgcacat

SEQ ID NO: 76591 - DNA, 15 bp, Homo sapiens
gacctcgtgcacatc

SEQ ID NO: 76592 - DNA, 15 bp, Homo sapiens
acctcgtgcacatcc

SEQ ID NO: 76593 - DNA, 15 bp, Homo sapiens
cctcgtgcacatcct

SEQ ID NO: 76594 - DNA, 15 bp, Homo sapiens
ctcgtgcacatcctc

SEQ ID NO: 76595 - DNA, 15 bp, Homo sapiens
tcgtgcacatcctca

SEQ ID NO: 76596 - DNA, 15 bp, Homo sapiens
cgtgcacatcctcac

SEQ ID NO: 76597 - DNA, 15 bp, Homo sapiens
gtgcacatcctcacg

SEQ ID NO: 76598 - DNA, 15 bp, Homo sapiens
tgcacatcctcacgc

SEQ ID NO: 76599 - DNA, 15 bp, Homo sapiens
gcacatcctcacgca

SEQ ID NO: 76600 - DNA, 15 bp, Homo sapiens
cacatcctcacgcac

SEQ ID NO: 76601 - DNA, 15 bp, Homo sapiens
acatcctcacgcacc

SEQ ID NO: 76602 - DNA, 15 bp, Homo sapiens
catcctcacgcacct

SEQ ID NO: 76603 - DNA, 15 bp, Homo sapiens
atcctcacgcacctg

SEQ ID NO: 76604 - DNA, 15 bp, Homo sapiens
tcctcacgcacctgc

SEQ ID NO: 76605 - DNA, 15 bp, Homo sapiens
cctcacgcacctgca

SEQ ID NO: 76606 - DNA, 15 bp, Homo sapiens
ctcacgcacctgcag

SEQ ID NO: 76607 - DNA, 15 bp, Homo sapiens
tcacgcacctgcagc

SEQ ID NO: 76608 - DNA, 15 bp, Homo sapiens
cacgcacctgcagct

SEQ ID NO: 76609 - DNA, 15 bp, Homo sapiens
acgcacctgcagctg

SEQ ID NO: 76610 - DNA, 15 bp, Homo sapiens
cgcacctgcagctgc

SEQ ID NO: 76611 - DNA, 15 bp, Homo sapiens
gcacctgcagctgct

SEQ ID NO: 76612 - DNA, 15 bp, Homo sapiens
cacctgcagctgctc

SEQ ID NO: 76613 - DNA, 15 bp, Homo sapiens
acctgcagctgctcc

SEQ ID NO: 76614 - DNA, 15 bp, Homo sapiens
cctgcagctgctccg

SEQ ID NO: 76615 - DNA, 15 bp, Homo sapiens
ctgcagctgctccgt

SEQ ID NO: 76616 - DNA, 15 bp, Homo sapiens
tgcagctgctccgtg

SEQ ID NO: 76617 - DNA, 15 bp, Homo sapiens
gcagctgctccgtgc

SEQ ID NO: 76618 - DNA, 15 bp, Homo sapiens
cagctgctccgtgcg

SEQ ID NO: 76619 - DNA, 15 bp, Homo sapiens
agctgctccgtgcgc

SEQ ID NO: 76620 - DNA, 15 bp, Homo sapiens
gctgctccgtgcgcg

SEQ ID NO: 76621 - DNA, 15 bp, Homo sapiens
ctgctccgtgcgcgg

SEQ ID NO: 76622 - DNA, 15 bp, Homo sapiens
tgctccgtgcgcggg

SEQ ID NO: 76623 - DNA, 15 bp, Homo sapiens
gctccgtgcgcggga

SEQ ID NO: 76624 - DNA, 15 bp, Homo sapiens
ctccgtgcgcgggac

SEQ ID NO: 76625 - DNA, 15 bp, Homo sapiens
tccgtgcgcgggaca

SEQ ID NO: 76626 - DNA, 15 bp, Homo sapiens
ccgtgcgcgggacat

SEQ ID NO: 76627 - DNA, 15 bp, Homo sapiens
cgtgcgcgggacatc

SEQ ID NO: 76628 - DNA, 15 bp, Homo sapiens
gtgcgcgggacatca

SEQ ID NO: 76629 - DNA, 15 bp, Homo sapiens
tgcgcgggacatcat

SEQ ID NO: 76630 - DNA, 15 bp, Homo sapiens
gcgcgggacatcatc

SEQ ID NO: 76631 - DNA, 15 bp, Homo sapiens
cgcgggacatcatca

SEQ ID NO: 76632 - DNA, 15 bp, Homo sapiens
gcgggacatcatcac

SEQ ID NO: 76633 - DNA, 15 bp, Homo sapiens
cgggacatcatcaca

SEQ ID NO: 76634 - DNA, 15 bp, Homo sapiens
gggacatcatcacag

SEQ ID NO: 76635 - DNA, 15 bp, Homo sapiens
ggacatcatcacagc

SEQ ID NO: 76636 - DNA, 15 bp, Homo sapiens
gacatcatcacagcc

SEQ ID NO: 76637 - DNA, 15 bp, Homo sapiens
acatcatcacagcct

SEQ ID NO: 76638 - DNA, 15 bp, Homo sapiens
catcatcacagcctg

SEQ ID NO: 76639 - DNA, 15 bp, Homo sapiens
atcatcacagcctgt

SEQ ID NO: 76640 - DNA, 15 bp, Homo sapiens
tcatcacagcctgtg

SEQ ID NO: 76641 - DNA, 15 bp, Homo sapiens
catcacagcctgtga

SEQ ID NO: 76642 - DNA, 15 bp, Homo sapiens
atcacagcctgtgag

SEQ ID NO: 76643 - DNA, 15 bp, Homo sapiens
tcacagcctgtgagc

SEQ ID NO: 76644 - DNA, 15 bp, Homo sapiens
cacagcctgtgagcg

SEQ ID NO: 76645 - DNA, 15 bp, Homo sapiens
acagcctgtgagcgc

SEQ ID NO: 76646 - DNA, 15 bp, Homo sapiens
cagcctgtgagcgcg

SEQ ID NO: 76647 - DNA, 15 bp, Homo sapiens
agcctgtgagcgcgg

SEQ ID NO: 76648 - DNA, 15 bp, Homo sapiens
gcctgtgagcgcggg

SEQ ID NO: 76649 - DNA, 15 bp, Homo sapiens
cctgtgagcgcggga

SEQ ID NO: 76650 - DNA, 15 bp, Homo sapiens
ctgtgagcgcgggac

SEQ ID NO: 76651 - DNA, 15 bp, Homo sapiens
tgtgagcgcgggact

SEQ ID NO: 76652 - DNA, 15 bp, Homo sapiens
gtgagcgcgggactc

SEQ ID NO: 76653 - DNA, 15 bp, Homo sapiens
tgagcgcgggactcc

SEQ ID NO: 76654 - DNA, 15 bp, Homo sapiens
gagcgcgggactccg

SEQ ID NO: 76655 - DNA, 15 bp, Homo sapiens
agcgcgggactccgg

SEQ ID NO: 76656 - DNA, 15 bp, Homo sapiens
gcgcgggactccggg

SEQ ID NO: 76657 - DNA, 15 bp, Homo sapiens
cgcgggactccgggc

SEQ ID NO: 76658 - DNA, 15 bp, Homo sapiens
gcgggactccgggca

SEQ ID NO: 76659 - DNA, 15 bp, Homo sapiens
cgggactccgggcac

SEQ ID NO: 76660 - DNA, 15 bp, Homo sapiens
gggactccgggcacc

SEQ ID NO: 76661 - DNA, 15 bp, Homo sapiens
ggactccgggcaccc

SEQ ID NO: 76662 - DNA, 15 bp, Homo sapiens
gactccgggcacccc

SEQ ID NO: 76663 - DNA, 15 bp, Homo sapiens
actccgggcacccca

SEQ ID NO: 76664 - DNA, 15 bp, Homo sapiens
ctccgggcaccccac

SEQ ID NO: 76665 - DNA, 15 bp, Homo sapiens
tccgggcaccccacg

SEQ ID NO: 76666 - DNA, 15 bp, Homo sapiens
ccgggcaccccacgg

SEQ ID NO: 76667 - DNA, 15 bp, Homo sapiens
cgggcaccccacggc

SEQ ID NO: 76668 - DNA, 15 bp, Homo sapiens
gggcaccccacggct

SEQ ID NO: 76669 - DNA, 15 bp, Homo sapiens
ggcaccccacggctg

SEQ ID NO: 76670 - DNA, 15 bp, Homo sapiens
gcaccccacggctgg

SEQ ID NO: 76671 - DNA, 15 bp, Homo sapiens
caccccacggctggg

SEQ ID NO: 76672 - DNA, 15 bp, Homo sapiens
accccacggctggga

SEQ ID NO: 76673 - DNA, 15 bp, Homo sapiens
ccccacggctgggag

SEQ ID NO: 76674 - DNA, 15 bp, Homo sapiens
cccacggctgggagg

SEQ ID NO: 76675 - DNA, 15 bp, Homo sapiens
ccacggctgggaggc

SEQ ID NO: 76676 - DNA, 15 bp, Homo sapiens
cacggctgggaggcc

SEQ ID NO: 76677 - DNA, 15 bp, Homo sapiens
acggctgggaggccg

SEQ ID NO: 76678 - DNA, 15 bp, Homo sapiens
cggctgggaggccgg

SEQ ID NO: 76679 - DNA, 15 bp, Homo sapiens
ggctgggaggccggc

SEQ ID NO: 76680 - DNA, 15 bp, Homo sapiens
gctgggaggccggcg

SEQ ID NO: 76681 - DNA, 15 bp, Homo sapiens
ctgggaggccggcgg

SEQ ID NO: 76682 - DNA, 15 bp, Homo sapiens
tgggaggccggcggg

SEQ ID NO: 76683 - DNA, 15 bp, Homo sapiens
gggaggccggcgggc

SEQ ID NO: 76684 - DNA, 15 bp, Homo sapiens
ggaggccggcgggcc

SEQ ID NO: 76685 - DNA, 15 bp, Homo sapiens
gaggccggcgggccc

SEQ ID NO: 76686 - DNA, 15 bp, Homo sapiens
aggccggcgggcccc

SEQ ID NO: 76687 - DNA, 15 bp, Homo sapiens
ggccggcgggcccca

SEQ ID NO: 76688 - DNA, 15 bp, Homo sapiens
gccggcgggccccac

SEQ ID NO: 76689 - DNA, 15 bp, Homo sapiens
ccggcgggccccacg

SEQ ID NO: 76690 - DNA, 15 bp, Homo sapiens
cggcgggccccacgg

SEQ ID NO: 76691 - DNA, 15 bp, Homo sapiens
ggcgggccccacggg

SEQ ID NO: 76692 - DNA, 15 bp, Homo sapiens
gcgggccccacgggg

SEQ ID NO: 76693 - DNA, 15 bp, Homo sapiens
cgggccccacggggc

SEQ ID NO: 76694 - DNA, 15 bp, Homo sapiens
gggccccacggggct

SEQ ID NO: 76695 - DNA, 15 bp, Homo sapiens
ggccccacggggctc

SEQ ID NO: 76696 - DNA, 15 bp, Homo sapiens
gccccacggggctcc

SEQ ID NO: 76697 - DNA, 15 bp, Homo sapiens
ccccacggggctccc

SEQ ID NO: 76698 - DNA, 15 bp, Homo sapiens
cccacggggctcccc

SEQ ID NO: 76699 - DNA, 15 bp, Homo sapiens
ccacggggctccccc

SEQ ID NO: 76700 - DNA, 15 bp, Homo sapiens
cacggggctccccca

SEQ ID NO: 76701 - DNA, 15 bp, Homo sapiens
acggggctcccccac

SEQ ID NO: 76702 - DNA, 15 bp, Homo sapiens
cggggctcccccacc

SEQ ID NO: 76703 - DNA, 15 bp, Homo sapiens
ggggctcccccaccc

SEQ ID NO: 76704 - DNA, 15 bp, Homo sapiens
gggctcccccacccg

SEQ ID NO: 76705 - DNA, 15 bp, Homo sapiens
ggctcccccacccgg

SEQ ID NO: 76706 - DNA, 15 bp, Homo sapiens
gctcccccacccggg

SEQ ID NO: 76707 - DNA, 15 bp, Homo sapiens
ctcccccacccgggc

SEQ ID NO: 76708 - DNA, 15 bp, Homo sapiens
tcccccacccgggcc

SEQ ID NO: 76709 - DNA, 15 bp, Homo sapiens
cccccacccgggcct

SEQ ID NO: 76710 - DNA, 15 bp, Homo sapiens
ccccacccgggcctc

SEQ ID NO: 76711 - DNA, 15 bp, Homo sapiens
cccacccgggcctca

SEQ ID NO: 76712 - DNA, 15 bp, Homo sapiens
ccacccgggcctcaa

SEQ ID NO: 76713 - DNA, 15 bp, Homo sapiens
cacccgggcctcaac

SEQ ID NO: 76714 - DNA, 15 bp, Homo sapiens
acccgggcctcaacc

SEQ ID NO: 76715 - DNA, 15 bp, Homo sapiens
cccgggcctcaacct

SEQ ID NO: 76716 - DNA, 15 bp, Homo sapiens
ccgggcctcaacctt

SEQ ID NO: 76717 - DNA, 15 bp, Homo sapiens
cgggcctcaaccttc

SEQ ID NO: 76718 - DNA, 15 bp, Homo sapiens
gggcctcaaccttcc

SEQ ID NO: 76719 - DNA, 15 bp, Homo sapiens
ggcctcaaccttcct

SEQ ID NO: 76720 - DNA, 15 bp, Homo sapiens
gcctcaaccttcctt

SEQ ID NO: 76721 - DNA, 15 bp, Homo sapiens
cctcaaccttccttt

SEQ ID NO: 76722 - DNA, 15 bp, Homo sapiens
ctcaaccttcctttc

SEQ ID NO: 76723 - DNA, 15 bp, Homo sapiens
tcaaccttcctttcc

SEQ ID NO: 76724 - DNA, 15 bp, Homo sapiens
caaccttcctttcct

SEQ ID NO: 76725 - DNA, 15 bp, Homo sapiens
aaccttcctttcctt

SEQ ID NO: 76726 - DNA, 15 bp, Homo sapiens
accttcctttccttc

SEQ ID NO: 76727 - DNA, 15 bp, Homo sapiens
ccttcctttccttcc

SEQ ID NO: 76728 - DNA, 15 bp, Homo sapiens
cttcctttccttcct

SEQ ID NO: 76729 - DNA, 15 bp, Homo sapiens
ttcctttccttcctt

SEQ ID NO: 76730 - DNA, 15 bp, Homo sapiens
tcctttccttccttg

SEQ ID NO: 76731 - DNA, 15 bp, Homo sapiens
cctttccttccttgg

SEQ ID NO: 76732 - DNA, 15 bp, Homo sapiens
ctttccttccttggc

SEQ ID NO: 76733 - DNA, 15 bp, Homo sapiens
tttccttccttggcg

SEQ ID NO: 76734 - DNA, 15 bp, Homo sapiens
ttccttccttggcgt

SEQ ID NO: 76735 - DNA, 15 bp, Homo sapiens
tccttccttggcgtc

SEQ ID NO: 76736 - DNA, 15 bp, Homo sapiens
ccttccttggcgtcc

SEQ ID NO: 76737 - DNA, 15 bp, Homo sapiens
cttccttggcgtccc

SEQ ID NO: 76738 - DNA, 15 bp, Homo sapiens
ttccttggcgtccca

SEQ ID NO: 76739 - DNA, 15 bp, Homo sapiens
tccttggcgtcccag

SEQ ID NO: 76740 - DNA, 15 bp, Homo sapiens
ccttggcgtcccagg

SEQ ID NO: 76741 - DNA, 15 bp, Homo sapiens
cttggcgtcccaggg

SEQ ID NO: 76742 - DNA, 15 bp, Homo sapiens
ttggcgtcccagggc

SEQ ID NO: 76743 - DNA, 15 bp, Homo sapiens
tggcgtcccagggca

SEQ ID NO: 76744 - DNA, 15 bp, Homo sapiens
ggcgtcccagggcac

SEQ ID NO: 76745 - DNA, 15 bp, Homo sapiens
gcgtcccagggcacc

SEQ ID NO: 76746 - DNA, 15 bp, Homo sapiens
cgtcccagggcaccc

SEQ ID NO: 76747 - DNA, 15 bp, Homo sapiens
gtcccagggcaccct

SEQ ID NO: 76748 - DNA, 15 bp, Homo sapiens
tcccagggcaccctc

SEQ ID NO: 76749 - DNA, 15 bp, Homo sapiens
cccagggcaccctcc

SEQ ID NO: 76750 - DNA, 15 bp, Homo sapiens
ccagggcaccctccc

SEQ ID NO: 76751 - DNA, 15 bp, Homo sapiens
cagggcaccctcccg

SEQ ID NO: 76752 - DNA, 15 bp, Homo sapiens
agggcaccctcccgc

SEQ ID NO: 76753 - DNA, 15 bp, Homo sapiens
gggcaccctcccgcc

SEQ ID NO: 76754 - DNA, 15 bp, Homo sapiens
ggcaccctcccgccc

SEQ ID NO: 76755 - DNA, 15 bp, Homo sapiens
gcaccctcccgcccc

SEQ ID NO: 76756 - DNA, 15 bp, Homo sapiens
caccctcccgccccg

SEQ ID NO: 76757 - DNA, 15 bp, Homo sapiens
accctcccgccccgc

SEQ ID NO: 76758 - DNA, 15 bp, Homo sapiens
ccctcccgccccgct

SEQ ID NO: 76759 - DNA, 15 bp, Homo sapiens
cctcccgccccgctt

SEQ ID NO: 76760 - DNA, 15 bp, Homo sapiens
ctcccgccccgcttc

SEQ ID NO: 76761 - DNA, 15 bp, Homo sapiens
tcccgccccgcttcc

SEQ ID NO: 76762 - DNA, 15 bp, Homo sapiens
cccgccccgcttccg

SEQ ID NO: 76763 - DNA, 15 bp, Homo sapiens
ccgccccgcttccgt

SEQ ID NO: 76764 - DNA, 15 bp, Homo sapiens
cgccccgcttccgtc

SEQ ID NO: 76765 - DNA, 15 bp, Homo sapiens
gccccgcttccgtcc

SEQ ID NO: 76766 - DNA, 15 bp, Homo sapiens
ccccgcttccgtccc

SEQ ID NO: 76767 - DNA, 15 bp, Homo sapiens
cccgcttccgtcccc

SEQ ID NO: 76768 - DNA, 15 bp, Homo sapiens
ccgcttccgtcccca

SEQ ID NO: 76769 - DNA, 15 bp, Homo sapiens
cgcttccgtccccag

SEQ ID NO: 76770 - DNA, 15 bp, Homo sapiens
gcttccgtccccagg

SEQ ID NO: 76771 - DNA, 15 bp, Homo sapiens
cttccgtccccaggc

SEQ ID NO: 76772 - DNA, 15 bp, Homo sapiens
ttccgtccccaggca

SEQ ID NO: 76773 - DNA, 15 bp, Homo sapiens
tccgtccccaggcac

SEQ ID NO: 76774 - DNA, 15 bp, Homo sapiens
ccgtccccaggcacc

SEQ ID NO: 76775 - DNA, 15 bp, Homo sapiens
cgtccccaggcacca

SEQ ID NO: 76776 - DNA, 15 bp, Homo sapiens
gtccccaggcaccac

SEQ ID NO: 76777 - DNA, 15 bp, Homo sapiens
tccccaggcaccact

SEQ ID NO: 76778 - DNA, 15 bp, Homo sapiens
ccccaggcaccactg

SEQ ID NO: 76779 - DNA, 15 bp, Homo sapiens
cccaggcaccactgc

SEQ ID NO: 76780 - DNA, 15 bp, Homo sapiens
ccaggcaccactgcc

SEQ ID NO: 76781 - DNA, 15 bp, Homo sapiens
caggcaccactgccc

SEQ ID NO: 76782 - DNA, 15 bp, Homo sapiens
aggcaccactgcccc

SEQ ID NO: 76783 - DNA, 15 bp, Homo sapiens
ggcaccactgccccg

SEQ ID NO: 76784 - DNA, 15 bp, Homo sapiens
gcaccactgccccga

SEQ ID NO: 76785 - DNA, 15 bp, Homo sapiens
caccactgccccgag

SEQ ID NO: 76786 - DNA, 15 bp, Homo sapiens
accactgccccgagg

SEQ ID NO: 76787 - DNA, 15 bp, Homo sapiens
ccactgccccgaggc

SEQ ID NO: 76788 - DNA, 15 bp, Homo sapiens
cactgccccgaggcc

SEQ ID NO: 76789 - DNA, 15 bp, Homo sapiens
actgccccgaggccc

SEQ ID NO: 76790 - DNA, 15 bp, Homo sapiens
ctgccccgaggccca

SEQ ID NO: 76791 - DNA, 15 bp, Homo sapiens
tgccccgaggcccag

SEQ ID NO: 76792 - DNA, 15 bp, Homo sapiens
gccccgaggcccagc

SEQ ID NO: 76793 - DNA, 15 bp, Homo sapiens
ccccgaggcccagca

SEQ ID NO: 76794 - DNA, 15 bp, Homo sapiens
cccgaggcccagcag

SEQ ID NO: 76795 - DNA, 15 bp, Homo sapiens
ccgaggcccagcagc

SEQ ID NO: 76796 - DNA, 15 bp, Homo sapiens
cgaggcccagcagca

SEQ ID NO: 76797 - DNA, 15 bp, Homo sapiens
gaggcccagcagcat

SEQ ID NO: 76798 - DNA, 15 bp, Homo sapiens
aggcccagcagcatc

SEQ ID NO: 76799 - DNA, 15 bp, Homo sapiens
ggcccagcagcatcc

SEQ ID NO: 76800 - DNA, 15 bp, Homo sapiens
gcccagcagcatccc

SEQ ID NO: 76801 - DNA, 15 bp, Homo sapiens
cccagcagcatccct

SEQ ID NO: 76802 - DNA, 15 bp, Homo sapiens
ccagcagcatccctg

SEQ ID NO: 76803 - DNA, 15 bp, Homo sapiens
cagcagcatccctgc

SEQ ID NO: 76804 - DNA, 15 bp, Homo sapiens
agcagcatccctgca

SEQ ID NO: 76805 - DNA, 15 bp, Homo sapiens
gcagcatccctgcac

SEQ ID NO: 76806 - DNA, 15 bp, Homo sapiens
cagcatccctgcacc

SEQ ID NO: 76807 - DNA, 15 bp, Homo sapiens
agcatccctgcaccc

SEQ ID NO: 76808 - DNA, 15 bp, Homo sapiens
gcatccctgcacccg

SEQ ID NO: 76809 - DNA, 15 bp, Homo sapiens
catccctgcacccgc

SEQ ID NO: 76810 - DNA, 15 bp, Homo sapiens
atccctgcacccgcc

SEQ ID NO: 76811 - DNA, 15 bp, Homo sapiens
tccctgcacccgccg

SEQ ID NO: 76812 - DNA, 15 bp, Homo sapiens
ccctgcacccgccga

SEQ ID NO: 76813 - DNA, 15 bp, Homo sapiens
cctgcacccgccgag

SEQ ID NO: 76814 - DNA, 15 bp, Homo sapiens
ctgcacccgccgagg

SEQ ID NO: 76815 - DNA, 15 bp, Homo sapiens
tgcacccgccgaggc

SEQ ID NO: 76816 - DNA, 15 bp, Homo sapiens
gcacccgccgaggcc

SEQ ID NO: 76817 - DNA, 15 bp, Homo sapiens
cacccgccgaggccg

SEQ ID NO: 76818 - DNA, 15 bp, Homo sapiens
acccgccgaggccga

SEQ ID NO: 76819 - DNA, 15 bp, Homo sapiens
cccgccgaggccgag

SEQ ID NO: 76820 - DNA, 15 bp, Homo sapiens
ccgccgaggccgagg

SEQ ID NO: 76821 - DNA, 15 bp, Homo sapiens
cgccgaggccgaggc

SEQ ID NO: 76822 - DNA, 15 bp, Homo sapiens
gccgaggccgaggcc

SEQ ID NO: 76823 - DNA, 15 bp, Homo sapiens
ccgaggccgaggcct

SEQ ID NO: 76824 - DNA, 15 bp, Homo sapiens
cgaggccgaggcctg

SEQ ID NO: 76825 - DNA, 15 bp, Homo sapiens
gaggccgaggcctgg

SEQ ID NO: 76826 - DNA, 15 bp, Homo sapiens
aggccgaggcctgga

SEQ ID NO: 76827 - DNA, 15 bp, Homo sapiens
ggccgaggcctggag

SEQ ID NO: 76828 - DNA, 15 bp, Homo sapiens
gccgaggcctggagc

SEQ ID NO: 76829 - DNA, 15 bp, Homo sapiens
ccgaggcctggagcc

SEQ ID NO: 76830 - DNA, 15 bp, Homo sapiens
cgaggcctggagccc

SEQ ID NO: 76831 - DNA, 15 bp, Homo sapiens
gaggcctggagcccc

SEQ ID NO: 76832 - DNA, 15 bp, Homo sapiens
aggcctggagccccc

SEQ ID NO: 76833 - DNA, 15 bp, Homo sapiens
ggcctggagcccccg

SEQ ID NO: 76834 - DNA, 15 bp, Homo sapiens
gcctggagcccccgg

SEQ ID NO: 76835 - DNA, 15 bp, Homo sapiens
cctggagcccccgga

SEQ ID NO: 76836 - DNA, 15 bp, Homo sapiens
ctggagcccccggaa

SEQ ID NO: 76837 - DNA, 15 bp, Homo sapiens
tggagcccccggaag

SEQ ID NO: 76838 - DNA, 15 bp, Homo sapiens
ggagcccccggaagt

SEQ ID NO: 76839 - DNA, 15 bp, Homo sapiens
gagcccccggaagtt

SEQ ID NO: 76840 - DNA, 15 bp, Homo sapiens
agcccccggaagttg

SEQ ID NO: 76841 - DNA, 15 bp, Homo sapiens
gcccccggaagttgc

SEQ ID NO: 76842 - DNA, 15 bp, Homo sapiens
cccccggaagttgcc

SEQ ID NO: 76843 - DNA, 15 bp, Homo sapiens
ccccggaagttgcca

SEQ ID NO: 76844 - DNA, 15 bp, Homo sapiens
cccggaagttgccat

SEQ ID NO: 76845 - DNA, 15 bp, Homo sapiens
ccggaagttgccatc

SEQ ID NO: 76846 - DNA, 15 bp, Homo sapiens
cggaagttgccatcc

SEQ ID NO: 76847 - DNA, 15 bp, Homo sapiens
ggaagttgccatcct

SEQ ID NO: 76848 - DNA, 15 bp, Homo sapiens
gaagttgccatcctc

SEQ ID NO: 76849 - DNA, 15 bp, Homo sapiens
aagttgccatcctca

SEQ ID NO: 76850 - DNA, 15 bp, Homo sapiens
agttgccatcctcag

SEQ ID NO: 76851 - DNA, 15 bp, Homo sapiens
gttgccatcctcagc

SEQ ID NO: 76852 - DNA, 15 bp, Homo sapiens
ttgccatcctcagcc

SEQ ID NO: 76853 - DNA, 15 bp, Homo sapiens
tgccatcctcagcct

SEQ ID NO: 76854 - DNA, 15 bp, Homo sapiens
gccatcctcagcctc

SEQ ID NO: 76855 - DNA, 15 bp, Homo sapiens
ccatcctcagcctcc

SEQ ID NO: 76856 - DNA, 15 bp, Homo sapiens
catcctcagcctcca

SEQ ID NO: 76857 - DNA, 15 bp, Homo sapiens
atcctcagcctccac

SEQ ID NO: 76858 - DNA, 15 bp, Homo sapiens
tcctcagcctccacc

SEQ ID NO: 76859 - DNA, 15 bp, Homo sapiens
cctcagcctccacct

SEQ ID NO: 76860 - DNA, 15 bp, Homo sapiens
ctcagcctccacctt

SEQ ID NO: 76861 - DNA, 15 bp, Homo sapiens
tcagcctccaccttc

SEQ ID NO: 76862 - DNA, 15 bp, Homo sapiens
cagcctccaccttcc

SEQ ID NO: 76863 - DNA, 15 bp, Homo sapiens
agcctccaccttcct

SEQ ID NO: 76864 - DNA, 15 bp, Homo sapiens
gcctccaccttcctc

SEQ ID NO: 76865 - DNA, 15 bp, Homo sapiens
cctccaccttcctct

SEQ ID NO: 76866 - DNA, 15 bp, Homo sapiens
ctccaccttcctctc

SEQ ID NO: 76867 - DNA, 15 bp, Homo sapiens
tccaccttcctctcc

SEQ ID NO: 76868 - DNA, 15 bp, Homo sapiens
ccaccttcctctccc

SEQ ID NO: 76869 - DNA, 15 bp, Homo sapiens
caccttcctctcccc

SEQ ID NO: 76870 - DNA, 15 bp, Homo sapiens
accttcctctcccca

SEQ ID NO: 76871 - DNA, 15 bp, Homo sapiens
ccttcctctccccag

SEQ ID NO: 76872 - DNA, 15 bp, Homo sapiens
cttcctctccccagg

SEQ ID NO: 76873 - DNA, 15 bp, Homo sapiens
ttcctctccccaggt

SEQ ID NO: 76874 - DNA, 15 bp, Homo sapiens
tcctctccccaggta

SEQ ID NO: 76875 - DNA, 15 bp, Homo sapiens
cctctccccaggtaa

SEQ ID NO: 76876 - DNA, 15 bp, Homo sapiens
ctctccccaggtaag

SEQ ID NO: 76877 - DNA, 15 bp, Homo sapiens
tctccccaggtaaga

SEQ ID NO: 76878 - DNA, 15 bp, Homo sapiens
ctccccaggtaagag

SEQ ID NO: 76879 - DNA, 15 bp, Homo sapiens
tccccaggtaagagg

SEQ ID NO: 76880 - DNA, 15 bp, Homo sapiens
ccccaggtaagaggg

SEQ ID NO: 76881 - DNA, 15 bp, Homo sapiens
cccaggtaagagggc

SEQ ID NO: 76882 - DNA, 15 bp, Homo sapiens
ccaggtaagagggcc

SEQ ID NO: 76883 - DNA, 15 bp, Homo sapiens
caggtaagagggccc

SEQ ID NO: 76884 - DNA, 15 bp, Homo sapiens
aggtaagagggcccg

SEQ ID NO: 76885 - DNA, 15 bp, Homo sapiens
ggtaagagggcccgg

SEQ ID NO: 76886 - DNA, 15 bp, Homo sapiens
gtaagagggcccggt

SEQ ID NO: 76887 - DNA, 15 bp, Homo sapiens
taagagggcccggtt

SEQ ID NO: 76888 - DNA, 15 bp, Homo sapiens
aagagggcccggttg

SEQ ID NO: 76889 - DNA, 15 bp, Homo sapiens
agagggcccggttgt

SEQ ID NO: 76890 - DNA, 15 bp, Homo sapiens
gagggcccggttgtt

SEQ ID NO: 76891 - DNA, 15 bp, Homo sapiens
agggcccggttgtta

SEQ ID NO: 76892 - DNA, 15 bp, Homo sapiens
gggcccggttgttag

SEQ ID NO: 76893 - DNA, 15 bp, Homo sapiens
ggcccggttgttagg

SEQ ID NO: 76894 - DNA, 15 bp, Homo sapiens
gcccggttgttaggc

SEQ ID NO: 76895 - DNA, 15 bp, Homo sapiens
cccggttgttaggct

SEQ ID NO: 76896 - DNA, 15 bp, Homo sapiens
ccggttgttaggctc

SEQ ID NO: 76897 - DNA, 15 bp, Homo sapiens
cggttgttaggctcg

SEQ ID NO: 76898 - DNA, 15 bp, Homo sapiens
ggttgttaggctcgg

SEQ ID NO: 76899 - DNA, 15 bp, Homo sapiens
gttgttaggctcggt

SEQ ID NO: 76900 - DNA, 15 bp, Homo sapiens
ttgttaggctcggtg

SEQ ID NO: 76901 - DNA, 15 bp, Homo sapiens
tgttaggctcggtgg

SEQ ID NO: 76902 - DNA, 15 bp, Homo sapiens
gttaggctcggtgga

SEQ ID NO: 76903 - DNA, 15 bp, Homo sapiens
ttaggctcggtggac

SEQ ID NO: 76904 - DNA, 15 bp, Homo sapiens
taggctcggtggacc

SEQ ID NO: 76905 - DNA, 15 bp, Homo sapiens
aggctcggtggaccc

SEQ ID NO: 76906 - DNA, 15 bp, Homo sapiens
ggctcggtggaccca

SEQ ID NO: 76907 - DNA, 15 bp, Homo sapiens
gctcggtggacccaa

SEQ ID NO: 76908 - DNA, 15 bp, Homo sapiens
ctcggtggacccaaa

SEQ ID NO: 76909 - DNA, 15 bp, Homo sapiens
tcggtggacccaaag

SEQ ID NO: 76910 - DNA, 15 bp, Homo sapiens
cggtggacccaaaga

SEQ ID NO: 76911 - DNA, 15 bp, Homo sapiens
ggtggacccaaagaa

SEQ ID NO: 76912 - DNA, 15 bp, Homo sapiens
gtggacccaaagaag

SEQ ID NO: 76913 - DNA, 15 bp, Homo sapiens
tggacccaaagaaga

SEQ ID NO: 76914 - DNA, 15 bp, Homo sapiens
ggacccaaagaagag

SEQ ID NO: 76915 - DNA, 15 bp, Homo sapiens
gacccaaagaagagc

SEQ ID NO: 76916 - DNA, 15 bp, Homo sapiens
acccaaagaagagcc

SEQ ID NO: 76917 - DNA, 15 bp, Homo sapiens
cccaaagaagagccc

SEQ ID NO: 76918 - DNA, 15 bp, Homo sapiens
ccaaagaagagccca

SEQ ID NO: 76919 - DNA, 15 bp, Homo sapiens
caaagaagagcccac

SEQ ID NO: 76920 - DNA, 15 bp, Homo sapiens
aaagaagagcccacc

SEQ ID NO: 76921 - DNA, 15 bp, Homo sapiens
aagaagagcccacct

SEQ ID NO: 76922 - DNA, 15 bp, Homo sapiens
agaagagcccacctt

SEQ ID NO: 76923 - DNA, 15 bp, Homo sapiens
gaagagcccaccttg

SEQ ID NO: 76924 - DNA, 15 bp, Homo sapiens
aagagcccaccttga

SEQ ID NO: 76925 - DNA, 15 bp, Homo sapiens
agagcccaccttgac

SEQ ID NO: 76926 - DNA, 15 bp, Homo sapiens
gagcccaccttgacc

SEQ ID NO: 76927 - DNA, 15 bp, Homo sapiens
agcccaccttgacca

SEQ ID NO: 76928 - DNA, 15 bp, Homo sapiens
gcccaccttgaccac

SEQ ID NO: 76929 - DNA, 15 bp, Homo sapiens
cccaccttgaccacg

SEQ ID NO: 76930 - DNA, 15 bp, Homo sapiens
ccaccttgaccacgg

SEQ ID NO: 76931 - DNA, 15 bp, Homo sapiens
caccttgaccacggc

SEQ ID NO: 76932 - DNA, 15 bp, Homo sapiens
accttgaccacggcc

SEQ ID NO: 76933 - DNA, 15 bp, Homo sapiens
ccttgaccacggcca

SEQ ID NO: 76934 - DNA, 15 bp, Homo sapiens
cttgaccacggccac

SEQ ID NO: 76935 - DNA, 15 bp, Homo sapiens
ttgaccacggccacg

SEQ ID NO: 76936 - DNA, 15 bp, Homo sapiens
tgaccacggccacgg

SEQ ID NO: 76937 - DNA, 15 bp, Homo sapiens
gaccacggccacggc

SEQ ID NO: 76938 - DNA, 15 bp, Homo sapiens
accacggccacggct

SEQ ID NO: 76939 - DNA, 15 bp, Homo sapiens
ccacggccacggctg

SEQ ID NO: 76940 - DNA, 15 bp, Homo sapiens
cacggccacggctgt

SEQ ID NO: 76941 - DNA, 15 bp, Homo sapiens
acggccacggctgta

SEQ ID NO: 76942 - DNA, 15 bp, Homo sapiens
cggccacggctgtag

SEQ ID NO: 76943 - DNA, 15 bp, Homo sapiens
ggccacggctgtaga

SEQ ID NO: 76944 - DNA, 15 bp, Homo sapiens
gccacggctgtagac

SEQ ID NO: 76945 - DNA, 15 bp, Homo sapiens
ccacggctgtagacc

SEQ ID NO: 76946 - DNA, 15 bp, Homo sapiens
cacggctgtagaccc

SEQ ID NO: 76947 - DNA, 15 bp, Homo sapiens
acggctgtagaccct

SEQ ID NO: 76948 - DNA, 15 bp, Homo sapiens
cggctgtagaccctg

SEQ ID NO: 76949 - DNA, 15 bp, Homo sapiens
ggctgtagaccctgc

SEQ ID NO: 76950 - DNA, 15 bp, Homo sapiens
gctgtagaccctgct

SEQ ID NO: 76951 - DNA, 15 bp, Homo sapiens
ctgtagaccctgctg

SEQ ID NO: 76952 - DNA, 15 bp, Homo sapiens
tgtagaccctgctgc

SEQ ID NO: 76953 - DNA, 15 bp, Homo sapiens
gtagaccctgctgct

SEQ ID NO: 76954 - DNA, 15 bp, Homo sapiens
tagaccctgctgctg

SEQ ID NO: 76955 - DNA, 15 bp, Homo sapiens
agaccctgctgctgg

SEQ ID NO: 76956 - DNA, 15 bp, Homo sapiens
gaccctgctgctggt

SEQ ID NO: 76957 - DNA, 15 bp, Homo sapiens
accctgctgctggtc

SEQ ID NO: 76958 - DNA, 15 bp, Homo sapiens
ccctgctgctggtct

SEQ ID NO: 76959 - DNA, 15 bp, Homo sapiens
cctgctgctggtctc

SEQ ID NO: 76960 - DNA, 15 bp, Homo sapiens
ctgctgctggtctct

SEQ ID NO: 76961 - DNA, 15 bp, Homo sapiens
tgctgctggtctctg

SEQ ID NO: 76962 - DNA, 15 bp, Homo sapiens
gctgctggtctctgc

SEQ ID NO: 76963 - DNA, 15 bp, Homo sapiens
ctgctggtctctgcc

SEQ ID NO: 76964 - DNA, 15 bp, Homo sapiens
tgctggtctctgcct

SEQ ID NO: 76965 - DNA, 15 bp, Homo sapiens
gctggtctctgcctg

SEQ ID NO: 76966 - DNA, 15 bp, Homo sapiens
ctggtctctgcctgc

SEQ ID NO: 76967 - DNA, 15 bp, Homo sapiens
tggtctctgcctgcc

SEQ ID NO: 76968 - DNA, 15 bp, Homo sapiens
ggtctctgcctgcct

SEQ ID NO: 76969 - DNA, 15 bp, Homo sapiens
gtctctgcctgcctc

SEQ ID NO: 76970 - DNA, 15 bp, Homo sapiens
tctctgcctgcctct

SEQ ID NO: 76971 - DNA, 15 bp, Homo sapiens
ctctgcctgcctctc

SEQ ID NO: 76972 - DNA, 15 bp, Homo sapiens
tctgcctgcctctca

SEQ ID NO: 76973 - DNA, 15 bp, Homo sapiens
ctgcctgcctctcac

SEQ ID NO: 76974 - DNA, 15 bp, Homo sapiens
tgcctgcctctcact

SEQ ID NO: 76975 - DNA, 15 bp, Homo sapiens
gcctgcctctcactg

SEQ ID NO: 76976 - DNA, 15 bp, Homo sapiens
cctgcctctcactgg

SEQ ID NO: 76977 - DNA, 15 bp, Homo sapiens
ctgcctctcactggt

SEQ ID NO: 76978 - DNA, 15 bp, Homo sapiens
tgcctctcactggtg

SEQ ID NO: 76979 - DNA, 15 bp, Homo sapiens
gcctctcactggtgt

SEQ ID NO: 76980 - DNA, 15 bp, Homo sapiens
cctctcactggtgtc

SEQ ID NO: 76981 - DNA, 15 bp, Homo sapiens
ctctcactggtgtct

SEQ ID NO: 76982 - DNA, 15 bp, Homo sapiens
tctcactggtgtctt

SEQ ID NO: 76983 - DNA, 15 bp, Homo sapiens
ctcactggtgtcttt

SEQ ID NO: 76984 - DNA, 15 bp, Homo sapiens
tcactggtgtcttta

SEQ ID NO: 76985 - DNA, 15 bp, Homo sapiens
cactggtgtctttat

SEQ ID NO: 76986 - DNA, 15 bp, Homo sapiens
actggtgtctttatg

SEQ ID NO: 76987 - DNA, 15 bp, Homo sapiens
ctggtgtctttatga

SEQ ID NO: 76988 - DNA, 15 bp, Homo sapiens
tggtgtctttatgaa

SEQ ID NO: 76989 - DNA, 15 bp, Homo sapiens
ggtgtctttatgaag

SEQ ID NO: 76990 - DNA, 15 bp, Homo sapiens
gtgtctttatgaagc

SEQ ID NO: 76991 - DNA, 15 bp, Homo sapiens
tgtctttatgaagct

SEQ ID NO: 76992 - DNA, 15 bp, Homo sapiens
gtctttatgaagctt

SEQ ID NO: 76993 - DNA, 15 bp, Homo sapiens
tctttatgaagcttt

SEQ ID NO: 76994 - DNA, 15 bp, Homo sapiens
ctttatgaagctttt

SEQ ID NO: 76995 - DNA, 15 bp, Homo sapiens
tttatgaagcttttc

SEQ ID NO: 76996 - DNA, 15 bp, Homo sapiens
ttatgaagcttttcc

SEQ ID NO: 76997 - DNA, 15 bp, Homo sapiens
tatgaagcttttcca

SEQ ID NO: 76998 - DNA, 15 bp, Homo sapiens
atgaagcttttccag

SEQ ID NO: 76999 - DNA, 15 bp, Homo sapiens
tgaagcttttccagg

SEQ ID NO: 77000 - DNA, 15 bp, Homo sapiens
gaagcttttccaggc

SEQ ID NO: 77001 - DNA, 15 bp, Homo sapiens
aagcttttccaggct

SEQ ID NO: 77002 - DNA, 15 bp, Homo sapiens
agcttttccaggctc

SEQ ID NO: 77003 - DNA, 15 bp, Homo sapiens
gcttttccaggctcc

SEQ ID NO: 77004 - DNA, 15 bp, Homo sapiens
cttttccaggctccc

SEQ ID NO: 77005 - DNA, 15 bp, Homo sapiens
ttttccaggctccca

SEQ ID NO: 77006 - DNA, 15 bp, Homo sapiens
tttccaggctcccag

SEQ ID NO: 77007 - DNA, 15 bp, Homo sapiens
ttccaggctcccaga

SEQ ID NO: 77008 - DNA, 15 bp, Homo sapiens
tccaggctcccagac

SEQ ID NO: 77009 - DNA, 15 bp, Homo sapiens
ccaggctcccagacc

SEQ ID NO: 77010 - DNA, 15 bp, Homo sapiens
caggctcccagaccc

SEQ ID NO: 77011 - DNA, 15 bp, Homo sapiens
aggctcccagaccca

SEQ ID NO: 77012 - DNA, 15 bp, Homo sapiens
ggctcccagacccat

SEQ ID NO: 77013 - DNA, 15 bp, Homo sapiens
gctcccagacccatt

SEQ ID NO: 77014 - DNA, 15 bp, Homo sapiens
ctcccagacccattc

SEQ ID NO: 77015 - DNA, 15 bp, Homo sapiens
tcccagacccattca

SEQ ID NO: 77016 - DNA, 15 bp, Homo sapiens
cccagacccattcag

SEQ ID NO: 77017 - DNA, 15 bp, Homo sapiens
ccagacccattcagg

SEQ ID NO: 77018 - DNA, 15 bp, Homo sapiens
cagacccattcaggg

SEQ ID NO: 77019 - DNA, 15 bp, Homo sapiens
agacccattcagggc

SEQ ID NO: 77020 - DNA, 15 bp, Homo sapiens
gacccattcagggcc

SEQ ID NO: 77021 - DNA, 15 bp, Homo sapiens
acccattcagggcct

SEQ ID NO: 77022 - DNA, 15 bp, Homo sapiens
cccattcagggcctg

SEQ ID NO: 77023 - DNA, 15 bp, Homo sapiens
ccattcagggcctga

SEQ ID NO: 77024 - DNA, 15 bp, Homo sapiens
cattcagggcctgag

SEQ ID NO: 77025 - DNA, 15 bp, Homo sapiens
attcagggcctgagc

SEQ ID NO: 77026 - DNA, 15 bp, Homo sapiens
ttcagggcctgagct

SEQ ID NO: 77027 - DNA, 15 bp, Homo sapiens
tcagggcctgagctc

SEQ ID NO: 77028 - DNA, 15 bp, Homo sapiens
cagggcctgagctcg

SEQ ID NO: 77029 - DNA, 15 bp, Homo sapiens
agggcctgagctcgg

SEQ ID NO: 77030 - DNA, 15 bp, Homo sapiens
gggcctgagctcggc

SEQ ID NO: 77031 - DNA, 15 bp, Homo sapiens
ggcctgagctcggcc

SEQ ID NO: 77032 - DNA, 15 bp, Homo sapiens
gcctgagctcggcct

SEQ ID NO: 77033 - DNA, 15 bp, Homo sapiens
cctgagctcggcctg

SEQ ID NO: 77034 - DNA, 15 bp, Homo sapiens
ctgagctcggcctgg

SEQ ID NO: 77035 - DNA, 15 bp, Homo sapiens
tgagctcggcctggt

SEQ ID NO: 77036 - DNA, 15 bp, Homo sapiens
gagctcggcctggtc

SEQ ID NO: 77037 - DNA, 15 bp, Homo sapiens
agctcggcctggtcc

SEQ ID NO: 77038 - DNA, 15 bp, Homo sapiens
gctcggcctggtccc

SEQ ID NO: 77039 - DNA, 15 bp, Homo sapiens
ctcggcctggtccca

SEQ ID NO: 77040 - DNA, 15 bp, Homo sapiens
tcggcctggtcccaa

SEQ ID NO: 77041 - DNA, 15 bp, Homo sapiens
cggcctggtcccaag

SEQ ID NO: 77042 - DNA, 15 bp, Homo sapiens
ggcctggtcccaagc

SEQ ID NO: 77043 - DNA, 15 bp, Homo sapiens
gcctggtcccaagcc

SEQ ID NO: 77044 - DNA, 15 bp, Homo sapiens
cctggtcccaagccc

SEQ ID NO: 77045 - DNA, 15 bp, Homo sapiens
ctggtcccaagccct

SEQ ID NO: 77046 - DNA, 15 bp, Homo sapiens
tggtcccaagccctg

SEQ ID NO: 77047 - DNA, 15 bp, Homo sapiens
ggtcccaagccctgc

SEQ ID NO: 77048 - DNA, 15 bp, Homo sapiens
gtcccaagccctgct

SEQ ID NO: 77049 - DNA, 15 bp, Homo sapiens
tcccaagccctgctt

SEQ ID NO: 77050 - DNA, 15 bp, Homo sapiens
cccaagccctgcttc

SEQ ID NO: 77051 - DNA, 15 bp, Homo sapiens
ccaagccctgcttcc

SEQ ID NO: 77052 - DNA, 15 bp, Homo sapiens
caagccctgcttccc

SEQ ID NO: 77053 - DNA, 15 bp, Homo sapiens
aagccctgcttccct

SEQ ID NO: 77054 - DNA, 15 bp, Homo sapiens
agccctgcttccctg

SEQ ID NO: 77055 - DNA, 15 bp, Homo sapiens
gccctgcttccctgt

SEQ ID NO: 77056 - DNA, 15 bp, Homo sapiens
ccctgcttccctgtg

SEQ ID NO: 77057 - DNA, 15 bp, Homo sapiens
cctgcttccctgtgg

SEQ ID NO: 77058 - DNA, 15 bp, Homo sapiens
ctgcttccctgtggc

SEQ ID NO: 77059 - DNA, 15 bp, Homo sapiens
tgcttccctgtggcc

SEQ ID NO: 77060 - DNA, 15 bp, Homo sapiens
gcttccctgtggcct

SEQ ID NO: 77061 - DNA, 15 bp, Homo sapiens
cttccctgtggcctc

SEQ ID NO: 77062 - DNA, 15 bp, Homo sapiens
ttccctgtggcctcc

SEQ ID NO: 77063 - DNA, 15 bp, Homo sapiens
tccctgtggcctcca

SEQ ID NO: 77064 - DNA, 15 bp, Homo sapiens
ccctgtggcctccac

SEQ ID NO: 77065 - DNA, 15 bp, Homo sapiens
cctgtggcctccacc

SEQ ID NO: 77066 - DNA, 15 bp, Homo sapiens
ctgtggcctccaccg

SEQ ID NO: 77067 - DNA, 15 bp, Homo sapiens
tgtggcctccaccgc

SEQ ID NO: 77068 - DNA, 15 bp, Homo sapiens
gtggcctccaccgcc

SEQ ID NO: 77069 - DNA, 15 bp, Homo sapiens
tggcctccaccgcca

SEQ ID NO: 77070 - DNA, 15 bp, Homo sapiens
ggcctccaccgccat

SEQ ID NO: 77071 - DNA, 15 bp, Homo sapiens
gcctccaccgccatc

SEQ ID NO: 77072 - DNA, 15 bp, Homo sapiens
cctccaccgccatct

SEQ ID NO: 77073 - DNA, 15 bp, Homo sapiens
ctccaccgccatctc

SEQ ID NO: 77074 - DNA, 15 bp, Homo sapiens
tccaccgccatctcc

SEQ ID NO: 77075 - DNA, 15 bp, Homo sapiens
ccaccgccatctcca

SEQ ID NO: 77076 - DNA, 15 bp, Homo sapiens
caccgccatctccag

SEQ ID NO: 77077 - DNA, 15 bp, Homo sapiens
accgccatctccagc

SEQ ID NO: 77078 - DNA, 15 bp, Homo sapiens
ccgccatctccagcc

SEQ ID NO: 77079 - DNA, 15 bp, Homo sapiens
cgccatctccagccc

SEQ ID NO: 77080 - DNA, 15 bp, Homo sapiens
gccatctccagcccc

SEQ ID NO: 77081 - DNA, 15 bp, Homo sapiens
ccatctccagcccct

SEQ ID NO: 77082 - DNA, 15 bp, Homo sapiens
catctccagcccctt

SEQ ID NO: 77083 - DNA, 15 bp, Homo sapiens
atctccagccccttc

SEQ ID NO: 77084 - DNA, 15 bp, Homo sapiens
tctccagccccttct

SEQ ID NO: 77085 - DNA, 15 bp, Homo sapiens
ctccagccccttctt

SEQ ID NO: 77086 - DNA, 15 bp, Homo sapiens
tccagccccttcttc

SEQ ID NO: 77087 - DNA, 15 bp, Homo sapiens
ccagccccttcttct

SEQ ID NO: 77088 - DNA, 15 bp, Homo sapiens
cagccccttcttcta

SEQ ID NO: 77089 - DNA, 15 bp, Homo sapiens
agccccttcttctac

SEQ ID NO: 77090 - DNA, 15 bp, Homo sapiens
gccccttcttctacc

SEQ ID NO: 77091 - DNA, 15 bp, Homo sapiens
ccccttcttctacca

SEQ ID NO: 77092 - DNA, 15 bp, Homo sapiens
cccttcttctaccaa

SEQ ID NO: 77093 - DNA, 15 bp, Homo sapiens
ccttcttctaccaag

SEQ ID NO: 77094 - DNA, 15 bp, Homo sapiens
cttcttctaccaagg

SEQ ID NO: 77095 - DNA, 15 bp, Homo sapiens
ttcttctaccaaggt

SEQ ID NO: 77096 - DNA, 15 bp, Homo sapiens
tcttctaccaaggta

SEQ ID NO: 77097 - DNA, 15 bp, Homo sapiens
cttctaccaaggtag

SEQ ID NO: 77098 - DNA, 15 bp, Homo sapiens
ttctaccaaggtagg

SEQ ID NO: 77099 - DNA, 15 bp, Homo sapiens
tctaccaaggtaggt

SEQ ID NO: 77100 - DNA, 15 bp, Homo sapiens
ctaccaaggtaggtg

SEQ ID NO: 77101 - DNA, 15 bp, Homo sapiens
taccaaggtaggtgt

SEQ ID NO: 77102 - DNA, 15 bp, Homo sapiens
accaaggtaggtgtc

SEQ ID NO: 77103 - DNA, 15 bp, Homo sapiens
ccaaggtaggtgtcc

SEQ ID NO: 77104 - DNA, 15 bp, Homo sapiens
caaggtaggtgtccc

SEQ ID NO: 77105 - DNA, 15 bp, Homo sapiens
aaggtaggtgtcccc

SEQ ID NO: 77106 - DNA, 15 bp, Homo sapiens
aggtaggtgtcccct

SEQ ID NO: 77107 - DNA, 15 bp, Homo sapiens
ggtaggtgtcccctg

SEQ ID NO: 77108 - DNA, 15 bp, Homo sapiens
gtaggtgtcccctgc

SEQ ID NO: 77109 - DNA, 15 bp, Homo sapiens
taggtgtcccctgcc

SEQ ID NO: 77110 - DNA, 15 bp, Homo sapiens
aggtgtcccctgccc

SEQ ID NO: 77111 - DNA, 15 bp, Homo sapiens
ggtgtcccctgcccc

SEQ ID NO: 77112 - DNA, 15 bp, Homo sapiens
gtgtcccctgccccc

SEQ ID NO: 77113 - DNA, 15 bp, Homo sapiens
tgtcccctgcccccc

SEQ ID NO: 77114 - DNA, 15 bp, Homo sapiens
gtcccctgcccccca

SEQ ID NO: 77115 - DNA, 15 bp, Homo sapiens
tcccctgccccccag

SEQ ID NO: 77116 - DNA, 15 bp, Homo sapiens
cccctgccccccagg

SEQ ID NO: 77117 - DNA, 15 bp, Homo sapiens
ccctgccccccaggg

SEQ ID NO: 77118 - DNA, 15 bp, Homo sapiens
cctgccccccaggga

SEQ ID NO: 77119 - DNA, 15 bp, Homo sapiens
ctgccccccagggaa

SEQ ID NO: 77120 - DNA, 15 bp, Homo sapiens
tgccccccagggaag

SEQ ID NO: 77121 - DNA, 15 bp, Homo sapiens
gccccccagggaaga

SEQ ID NO: 77122 - DNA, 15 bp, Homo sapiens
ccccccagggaagat

SEQ ID NO: 77123 - DNA, 15 bp, Homo sapiens
cccccagggaagatt

SEQ ID NO: 77124 - DNA, 15 bp, Homo sapiens
ccccagggaagattc

SEQ ID NO: 77125 - DNA, 15 bp, Homo sapiens
cccagggaagattcg

SEQ ID NO: 77126 - DNA, 15 bp, Homo sapiens
ccagggaagattcga

SEQ ID NO: 77127 - DNA, 15 bp, Homo sapiens
cagggaagattcgag

SEQ ID NO: 77128 - DNA, 15 bp, Homo sapiens
agggaagattcgaga

SEQ ID NO: 77129 - DNA, 15 bp, Homo sapiens
gggaagattcgagac

SEQ ID NO: 77130 - DNA, 15 bp, Homo sapiens
ggaagattcgagaca

SEQ ID NO: 77131 - DNA, 15 bp, Homo sapiens
gaagattcgagacaa

SEQ ID NO: 77132 - DNA, 15 bp, Homo sapiens
aagattcgagacaag

SEQ ID NO: 77133 - DNA, 15 bp, Homo sapiens
agattcgagacaagg

SEQ ID NO: 77134 - DNA, 15 bp, Homo sapiens
gattcgagacaagga

SEQ ID NO: 77135 - DNA, 15 bp, Homo sapiens
attcgagacaaggag

SEQ ID NO: 77136 - DNA, 15 bp, Homo sapiens
ttcgagacaaggagg

SEQ ID NO: 77137 - DNA, 15 bp, Homo sapiens
tcgagacaaggagga

SEQ ID NO: 77138 - DNA, 15 bp, Homo sapiens
cgagacaaggaggaa

SEQ ID NO: 77139 - DNA, 15 bp, Homo sapiens
gagacaaggaggaag

SEQ ID NO: 77140 - DNA, 15 bp, Homo sapiens
agacaaggaggaagg

SEQ ID NO: 77141 - DNA, 15 bp, Homo sapiens
gacaaggaggaagga

SEQ ID NO: 77142 - DNA, 15 bp, Homo sapiens
acaaggaggaaggaa

SEQ ID NO: 77143 - DNA, 15 bp, Homo sapiens
caaggaggaaggaat

SEQ ID NO: 77144 - DNA, 15 bp, Homo sapiens
aaggaggaaggaatt

SEQ ID NO: 77145 - DNA, 15 bp, Homo sapiens
aggaggaaggaattc

SEQ ID NO: 77146 - DNA, 15 bp, Homo sapiens
ggaggaaggaattca

SEQ ID NO: 77147 - DNA, 15 bp, Homo sapiens
gaggaaggaattcag

SEQ ID NO: 77148 - DNA, 15 bp, Homo sapiens
aggaaggaattcagc

SEQ ID NO: 77149 - DNA, 15 bp, Homo sapiens
ggaaggaattcagcc

SEQ ID NO: 77150 - DNA, 15 bp, Homo sapiens
gaaggaattcagcct

SEQ ID NO: 77151 - DNA, 15 bp, Homo sapiens
aaggaattcagcctt

SEQ ID NO: 77152 - DNA, 15 bp, Homo sapiens
aggaattcagccttt

SEQ ID NO: 77153 - DNA, 15 bp, Homo sapiens
ggaattcagcctttg

SEQ ID NO: 77154 - DNA, 15 bp, Homo sapiens
gaattcagcctttga

SEQ ID NO: 77155 - DNA, 15 bp, Homo sapiens
aattcagcctttgat

SEQ ID NO: 77156 - DNA, 15 bp, Homo sapiens
attcagcctttgatg

SEQ ID NO: 77157 - DNA, 15 bp, Homo sapiens
ttcagcctttgatgt

SEQ ID NO: 77158 - DNA, 15 bp, Homo sapiens
tcagcctttgatgta

SEQ ID NO: 77159 - DNA, 15 bp, Homo sapiens
cagcctttgatgtag

SEQ ID NO: 77160 - DNA, 15 bp, Homo sapiens
agcctttgatgtagc

SEQ ID NO: 77161 - DNA, 15 bp, Homo sapiens
gcctttgatgtagcg

SEQ ID NO: 77162 - DNA, 15 bp, Homo sapiens
cctttgatgtagcgc

SEQ ID NO: 77163 - DNA, 15 bp, Homo sapiens
ctttgatgtagcgca

SEQ ID NO: 77164 - DNA, 15 bp, Homo sapiens
tttgatgtagcgcag

SEQ ID NO: 77165 - DNA, 15 bp, Homo sapiens
ttgatgtagcgcaga

SEQ ID NO: 77166 - DNA, 15 bp, Homo sapiens
tgatgtagcgcagag

SEQ ID NO: 77167 - DNA, 15 bp, Homo sapiens
gatgtagcgcagagc

SEQ ID NO: 77168 - DNA, 15 bp, Homo sapiens
atgtagcgcagagcc

SEQ ID NO: 77169 - DNA, 15 bp, Homo sapiens
tgtagcgcagagccc

SEQ ID NO: 77170 - DNA, 15 bp, Homo sapiens
gtagcgcagagcccc

SEQ ID NO: 77171 - DNA, 15 bp, Homo sapiens
tagcgcagagcccca

SEQ ID NO: 77172 - DNA, 15 bp, Homo sapiens
agcgcagagccccag

SEQ ID NO: 77173 - DNA, 15 bp, Homo sapiens
gcgcagagccccagt

SEQ ID NO: 77174 - DNA, 15 bp, Homo sapiens
cgcagagccccagtc

SEQ ID NO: 77175 - DNA, 15 bp, Homo sapiens
gcagagccccagtca

SEQ ID NO: 77176 - DNA, 15 bp, Homo sapiens
cagagccccagtcag

SEQ ID NO: 77177 - DNA, 15 bp, Homo sapiens
agagccccagtcagc

SEQ ID NO: 77178 - DNA, 15 bp, Homo sapiens
gagccccagtcagcc

SEQ ID NO: 77179 - DNA, 15 bp, Homo sapiens
agccccagtcagcca

SEQ ID NO: 77180 - DNA, 15 bp, Homo sapiens
gccccagtcagccaa

SEQ ID NO: 77181 - DNA, 15 bp, Homo sapiens
ccccagtcagccaag

SEQ ID NO: 77182 - DNA, 15 bp, Homo sapiens
cccagtcagccaagc

SEQ ID NO: 77183 - DNA, 15 bp, Homo sapiens
ccagtcagccaagct

SEQ ID NO: 77184 - DNA, 15 bp, Homo sapiens
cagtcagccaagctg

SEQ ID NO: 77185 - DNA, 15 bp, Homo sapiens
agtcagccaagctgg

SEQ ID NO: 77186 - DNA, 15 bp, Homo sapiens
gtcagccaagctggg

SEQ ID NO: 77187 - DNA, 15 bp, Homo sapiens
tcagccaagctgggt

SEQ ID NO: 77188 - DNA, 15 bp, Homo sapiens
cagccaagctgggtc

SEQ ID NO: 77189 - DNA, 15 bp, Homo sapiens
agccaagctgggtca

SEQ ID NO: 77190 - DNA, 15 bp, Homo sapiens
gccaagctgggtcag

SEQ ID NO: 77191 - DNA, 15 bp, Homo sapiens
ccaagctgggtcagc

SEQ ID NO: 77192 - DNA, 15 bp, Homo sapiens
caagctgggtcagct

SEQ ID NO: 77193 - DNA, 15 bp, Homo sapiens
aagctgggtcagctg

SEQ ID NO: 77194 - DNA, 15 bp, Homo sapiens
agctgggtcagctgg

SEQ ID NO: 77195 - DNA, 15 bp, Homo sapiens
gctgggtcagctggg

SEQ ID NO: 77196 - DNA, 15 bp, Homo sapiens
ctgggtcagctggga

SEQ ID NO: 77197 - DNA, 15 bp, Homo sapiens
tgggtcagctgggag

SEQ ID NO: 77198 - DNA, 15 bp, Homo sapiens
gggtcagctgggagg

SEQ ID NO: 77199 - DNA, 15 bp, Homo sapiens
ggtcagctgggaggc

SEQ ID NO: 77200 - DNA, 15 bp, Homo sapiens
gtcagctgggaggca

SEQ ID NO: 77201 - DNA, 15 bp, Homo sapiens
tcagctgggaggcag

SEQ ID NO: 77202 - DNA, 15 bp, Homo sapiens
cagctgggaggcagc

SEQ ID NO: 77203 - DNA, 15 bp, Homo sapiens
agctgggaggcagct

SEQ ID NO: 77204 - DNA, 15 bp, Homo sapiens
gctgggaggcagctg

SEQ ID NO: 77205 - DNA, 15 bp, Homo sapiens
ctgggaggcagctgt

SEQ ID NO: 77206 - DNA, 15 bp, Homo sapiens
tgggaggcagctgtg

SEQ ID NO: 77207 - DNA, 15 bp, Homo sapiens
gggaggcagctgtgg

SEQ ID NO: 77208 - DNA, 15 bp, Homo sapiens
ggaggcagctgtggt

SEQ ID NO: 77209 - DNA, 15 bp, Homo sapiens
gaggcagctgtggtg

SEQ ID NO: 77210 - DNA, 15 bp, Homo sapiens
aggcagctgtggtgg

SEQ ID NO: 77211 - DNA, 15 bp, Homo sapiens
ggcagctgtggtggg

SEQ ID NO: 77212 - DNA, 15 bp, Homo sapiens
gcagctgtggtgggg

SEQ ID NO: 77213 - DNA, 15 bp, Homo sapiens
cagctgtggtgggga

SEQ ID NO: 77214 - DNA, 15 bp, Homo sapiens
agctgtggtggggag

SEQ ID NO: 77215 - DNA, 15 bp, Homo sapiens
gctgtggtggggaga

SEQ ID NO: 77216 - DNA, 15 bp, Homo sapiens
ctgtggtggggagag

SEQ ID NO: 77217 - DNA, 15 bp, Homo sapiens
tgtggtggggagagc

SEQ ID NO: 77218 - DNA, 15 bp, Homo sapiens
gtggtggggagagcc

SEQ ID NO: 77219 - DNA, 15 bp, Homo sapiens
tggtggggagagcct

SEQ ID NO: 77220 - DNA, 15 bp, Homo sapiens
ggtggggagagcctg

SEQ ID NO: 77221 - DNA, 15 bp, Homo sapiens
gtggggagagcctgg

SEQ ID NO: 77222 - DNA, 15 bp, Homo sapiens
tggggagagcctgga

SEQ ID NO: 77223 - DNA, 15 bp, Homo sapiens
ggggagagcctggag

SEQ ID NO: 77224 - DNA, 15 bp, Homo sapiens
gggagagcctggagc

SEQ ID NO: 77225 - DNA, 15 bp, Homo sapiens
ggagagcctggagcc

SEQ ID NO: 77226 - DNA, 15 bp, Homo sapiens
gagagcctggagcct

SEQ ID NO: 77227 - DNA, 15 bp, Homo sapiens
agagcctggagcctt

SEQ ID NO: 77228 - DNA, 15 bp, Homo sapiens
gagcctggagccttg

SEQ ID NO: 77229 - DNA, 15 bp, Homo sapiens
agcctggagccttgg

SEQ ID NO: 77230 - DNA, 15 bp, Homo sapiens
gcctggagccttggg

SEQ ID NO: 77231 - DNA, 15 bp, Homo sapiens
cctggagccttgggc

SEQ ID NO: 77232 - DNA, 15 bp, Homo sapiens
ctggagccttgggca

SEQ ID NO: 77233 - DNA, 15 bp, Homo sapiens
tggagccttgggcag

SEQ ID NO: 77234 - DNA, 15 bp, Homo sapiens
ggagccttgggcaga

SEQ ID NO: 77235 - DNA, 15 bp, Homo sapiens
gagccttgggcagaa

SEQ ID NO: 77236 - DNA, 15 bp, Homo sapiens
agccttgggcagaag

SEQ ID NO: 77237 - DNA, 15 bp, Homo sapiens
gccttgggcagaagg

SEQ ID NO: 77238 - DNA, 15 bp, Homo sapiens
ccttgggcagaaggg

SEQ ID NO: 77239 - DNA, 15 bp, Homo sapiens
cttgggcagaaggga

SEQ ID NO: 77240 - DNA, 15 bp, Homo sapiens
ttgggcagaagggaa

SEQ ID NO: 77241 - DNA, 15 bp, Homo sapiens
tgggcagaagggaag

SEQ ID NO: 77242 - DNA, 15 bp, Homo sapiens
gggcagaagggaaga

SEQ ID NO: 77243 - DNA, 15 bp, Homo sapiens
ggcagaagggaagag

SEQ ID NO: 77244 - DNA, 15 bp, Homo sapiens
gcagaagggaagaga

SEQ ID NO: 77245 - DNA, 15 bp, Homo sapiens
cagaagggaagagac

SEQ ID NO: 77246 - DNA, 15 bp, Homo sapiens
agaagggaagagaca

SEQ ID NO: 77247 - DNA, 15 bp, Homo sapiens
gaagggaagagacag

SEQ ID NO: 77248 - DNA, 15 bp, Homo sapiens
aagggaagagacagg

SEQ ID NO: 77249 - DNA, 15 bp, Homo sapiens
agggaagagacaggg

SEQ ID NO: 77250 - DNA, 15 bp, Homo sapiens
gggaagagacaggga

SEQ ID NO: 77251 - DNA, 15 bp, Homo sapiens
ggaagagacagggac

SEQ ID NO: 77252 - DNA, 15 bp, Homo sapiens
gaagagacagggacc

SEQ ID NO: 77253 - DNA, 15 bp, Homo sapiens
aagagacagggaccc

SEQ ID NO: 77254 - DNA, 15 bp, Homo sapiens
agagacagggacccc

SEQ ID NO: 77255 - DNA, 15 bp, Homo sapiens
gagacagggacccca

SEQ ID NO: 77256 - DNA, 15 bp, Homo sapiens
agacagggaccccac

SEQ ID NO: 77257 - DNA, 15 bp, Homo sapiens
gacagggaccccacc

SEQ ID NO: 77258 - DNA, 15 bp, Homo sapiens
acagggaccccacct

SEQ ID NO: 77259 - DNA, 15 bp, Homo sapiens
cagggaccccacctg

SEQ ID NO: 77260 - DNA, 15 bp, Homo sapiens
agggaccccacctga

SEQ ID NO: 77261 - DNA, 15 bp, Homo sapiens
gggaccccacctgat

SEQ ID NO: 77262 - DNA, 15 bp, Homo sapiens
ggaccccacctgatc

SEQ ID NO: 77263 - DNA, 15 bp, Homo sapiens
gaccccacctgatcc

SEQ ID NO: 77264 - DNA, 15 bp, Homo sapiens
accccacctgatcca

SEQ ID NO: 77265 - DNA, 15 bp, Homo sapiens
ccccacctgatccag

SEQ ID NO: 77266 - DNA, 15 bp, Homo sapiens
cccacctgatccagg

SEQ ID NO: 77267 - DNA, 15 bp, Homo sapiens
ccacctgatccaggc

SEQ ID NO: 77268 - DNA, 15 bp, Homo sapiens
cacctgatccaggct

SEQ ID NO: 77269 - DNA, 15 bp, Homo sapiens
acctgatccaggctc

SEQ ID NO: 77270 - DNA, 15 bp, Homo sapiens
cctgatccaggctct

SEQ ID NO: 77271 - DNA, 15 bp, Homo sapiens
ctgatccaggctctc

SEQ ID NO: 77272 - DNA, 15 bp, Homo sapiens
tgatccaggctctct

SEQ ID NO: 77273 - DNA, 15 bp, Homo sapiens
gatccaggctctctt

SEQ ID NO: 77274 - DNA, 15 bp, Homo sapiens
atccaggctctcttc

SEQ ID NO: 77275 - DNA, 15 bp, Homo sapiens
tccaggctctcttcc

SEQ ID NO: 77276 - DNA, 15 bp, Homo sapiens
ccaggctctcttccc

SEQ ID NO: 77277 - DNA, 15 bp, Homo sapiens
caggctctcttccca

SEQ ID NO: 77278 - DNA, 15 bp, Homo sapiens
aggctctcttcccac

SEQ ID NO: 77279 - DNA, 15 bp, Homo sapiens
ggctctcttcccaca

SEQ ID NO: 77280 - DNA, 15 bp, Homo sapiens
gctctcttcccacag

SEQ ID NO: 77281 - DNA, 15 bp, Homo sapiens
ctctcttcccacagc

SEQ ID NO: 77282 - DNA, 15 bp, Homo sapiens
tctcttcccacagcc

SEQ ID NO: 77283 - DNA, 15 bp, Homo sapiens
ctcttcccacagcca

SEQ ID NO: 77284 - DNA, 15 bp, Homo sapiens
tcttcccacagccag

SEQ ID NO: 77285 - DNA, 15 bp, Homo sapiens
cttcccacagccagg

SEQ ID NO: 77286 - DNA, 15 bp, Homo sapiens
ttcccacagccaggc

SEQ ID NO: 77287 - DNA, 15 bp, Homo sapiens
tcccacagccaggcc

SEQ ID NO: 77288 - DNA, 15 bp, Homo sapiens
cccacagccaggccc

SEQ ID NO: 77289 - DNA, 15 bp, Homo sapiens
ccacagccaggccca

SEQ ID NO: 77290 - DNA, 15 bp, Homo sapiens
cacagccaggcccag

SEQ ID NO: 77291 - DNA, 15 bp, Homo sapiens
acagccaggcccaga

SEQ ID NO: 77292 - DNA, 15 bp, Homo sapiens
cagccaggcccagag

SEQ ID NO: 77293 - DNA, 15 bp, Homo sapiens
agccaggcccagaga

SEQ ID NO: 77294 - DNA, 15 bp, Homo sapiens
gccaggcccagagag

SEQ ID NO: 77295 - DNA, 15 bp, Homo sapiens
ccaggcccagagagc

SEQ ID NO: 77296 - DNA, 15 bp, Homo sapiens
caggcccagagagct

SEQ ID NO: 77297 - DNA, 15 bp, Homo sapiens
aggcccagagagctc

SEQ ID NO: 77298 - DNA, 15 bp, Homo sapiens
ggcccagagagctca

SEQ ID NO: 77299 - DNA, 15 bp, Homo sapiens
gcccagagagctcag

SEQ ID NO: 77300 - DNA, 15 bp, Homo sapiens
cccagagagctcagt

SEQ ID NO: 77301 - DNA, 15 bp, Homo sapiens
ccagagagctcagtg

SEQ ID NO: 77302 - DNA, 15 bp, Homo sapiens
cagagagctcagtgt

SEQ ID NO: 77303 - DNA, 15 bp, Homo sapiens
agagagctcagtgtc

SEQ ID NO: 77304 - DNA, 15 bp, Homo sapiens
gagagctcagtgtcc

SEQ ID NO: 77305 - DNA, 15 bp, Homo sapiens
agagctcagtgtccc

SEQ ID NO: 77306 - DNA, 15 bp, Homo sapiens
gagctcagtgtccct

SEQ ID NO: 77307 - DNA, 15 bp, Homo sapiens
agctcagtgtccctc

SEQ ID NO: 77308 - DNA, 15 bp, Homo sapiens
gctcagtgtccctcc

SEQ ID NO: 77309 - DNA, 15 bp, Homo sapiens
ctcagtgtccctcct

SEQ ID NO: 77310 - DNA, 15 bp, Homo sapiens
tcagtgtccctcctg

SEQ ID NO: 77311 - DNA, 15 bp, Homo sapiens
cagtgtccctcctgc

SEQ ID NO: 77312 - DNA, 15 bp, Homo sapiens
agtgtccctcctgca

SEQ ID NO: 77313 - DNA, 15 bp, Homo sapiens
gtgtccctcctgcag

SEQ ID NO: 77314 - DNA, 15 bp, Homo sapiens
tgtccctcctgcagg

SEQ ID NO: 77315 - DNA, 15 bp, Homo sapiens
gtccctcctgcaggg

SEQ ID NO: 77316 - DNA, 15 bp, Homo sapiens
tccctcctgcaggga

SEQ ID NO: 77317 - DNA, 15 bp, Homo sapiens
ccctcctgcagggag

SEQ ID NO: 77318 - DNA, 15 bp, Homo sapiens
cctcctgcagggagc

SEQ ID NO: 77319 - DNA, 15 bp, Homo sapiens
ctcctgcagggagcc

SEQ ID NO: 77320 - DNA, 15 bp, Homo sapiens
tcctgcagggagccc

SEQ ID NO: 77321 - DNA, 15 bp, Homo sapiens
cctgcagggagcccg

SEQ ID NO: 77322 - DNA, 15 bp, Homo sapiens
ctgcagggagcccgc

SEQ ID NO: 77323 - DNA, 15 bp, Homo sapiens
tgcagggagcccgcc

SEQ ID NO: 77324 - DNA, 15 bp, Homo sapiens
gcagggagcccgccc

SEQ ID NO: 77325 - DNA, 15 bp, Homo sapiens
cagggagcccgcccc

SEQ ID NO: 77326 - DNA, 15 bp, Homo sapiens
agggagcccgcccct

SEQ ID NO: 77327 - DNA, 15 bp, Homo sapiens
gggagcccgcccctt

SEQ ID NO: 77328 - DNA, 15 bp, Homo sapiens
ggagcccgccccttt

SEQ ID NO: 77329 - DNA, 15 bp, Homo sapiens
gagcccgcccctttc

SEQ ID NO: 77330 - DNA, 15 bp, Homo sapiens
agcccgcccctttcc

SEQ ID NO: 77331 - DNA, 15 bp, Homo sapiens
gcccgcccctttccg

SEQ ID NO: 77332 - DNA, 15 bp, Homo sapiens
cccgcccctttccgt

SEQ ID NO: 77333 - DNA, 15 bp, Homo sapiens
ccgcccctttccgtt

SEQ ID NO: 77334 - DNA, 15 bp, Homo sapiens
cgcccctttccgttt

SEQ ID NO: 77335 - DNA, 15 bp, Homo sapiens
gcccctttccgtttt

SEQ ID NO: 77336 - DNA, 15 bp, Homo sapiens
cccctttccgttttg

SEQ ID NO: 77337 - DNA, 15 bp, Homo sapiens
ccctttccgttttgc

SEQ ID NO: 77338 - DNA, 15 bp, Homo sapiens
cctttccgttttgct

SEQ ID NO: 77339 - DNA, 15 bp, Homo sapiens
ctttccgttttgctg

SEQ ID NO: 77340 - DNA, 15 bp, Homo sapiens
tttccgttttgctgg

SEQ ID NO: 77341 - DNA, 15 bp, Homo sapiens
ttccgttttgctggc

SEQ ID NO: 77342 - DNA, 15 bp, Homo sapiens
tccgttttgctggcc

SEQ ID NO: 77343 - DNA, 15 bp, Homo sapiens
ccgttttgctggccc

SEQ ID NO: 77344 - DNA, 15 bp, Homo sapiens
cgttttgctggcccc

SEQ ID NO: 77345 - DNA, 15 bp, Homo sapiens
gttttgctggcccct

SEQ ID NO: 77346 - DNA, 15 bp, Homo sapiens
ttttgctggcccctc

SEQ ID NO: 77347 - DNA, 15 bp, Homo sapiens
tttgctggcccctct

SEQ ID NO: 77348 - DNA, 15 bp, Homo sapiens
ttgctggcccctctg

SEQ ID NO: 77349 - DNA, 15 bp, Homo sapiens
tgctggcccctctgt

SEQ ID NO: 77350 - DNA, 15 bp, Homo sapiens
gctggcccctctgtg

SEQ ID NO: 77351 - DNA, 15 bp, Homo sapiens
ctggcccctctgtga

SEQ ID NO: 77352 - DNA, 15 bp, Homo sapiens
tggcccctctgtgag

SEQ ID NO: 77353 - DNA, 15 bp, Homo sapiens
ggcccctctgtgaga

SEQ ID NO: 77354 - DNA, 15 bp, Homo sapiens
gcccctctgtgagat

SEQ ID NO: 77355 - DNA, 15 bp, Homo sapiens
cccctctgtgagatt

SEQ ID NO: 77356 - DNA, 15 bp, Homo sapiens
ccctctgtgagattt

SEQ ID NO: 77357 - DNA, 15 bp, Homo sapiens
cctctgtgagatttc

SEQ ID NO: 77358 - DNA, 15 bp, Homo sapiens
ctctgtgagatttcc

SEQ ID NO: 77359 - DNA, 15 bp, Homo sapiens
tctgtgagatttccc

SEQ ID NO: 77360 - DNA, 15 bp, Homo sapiens
ctgtgagatttcccg

SEQ ID NO: 77361 - DNA, 15 bp, Homo sapiens
tgtgagatttcccgg

SEQ ID NO: 77362 - DNA, 15 bp, Homo sapiens
gtgagatttcccggg

SEQ ID NO: 77363 - DNA, 15 bp, Homo sapiens
tgagatttcccgggg

SEQ ID NO: 77364 - DNA, 15 bp, Homo sapiens
gagatttcccggggc

SEQ ID NO: 77365 - DNA, 15 bp, Homo sapiens
agatttcccggggca

SEQ ID NO: 77366 - DNA, 15 bp, Homo sapiens
gatttcccggggcac

SEQ ID NO: 77367 - DNA, 15 bp, Homo sapiens
atttcccggggcacc

SEQ ID NO: 77368 - DNA, 15 bp, Homo sapiens
tttcccggggcaccc

SEQ ID NO: 77369 - DNA, 15 bp, Homo sapiens
ttcccggggcaccca

SEQ ID NO: 77370 - DNA, 15 bp, Homo sapiens
tcccggggcacccac

SEQ ID NO: 77371 - DNA, 15 bp, Homo sapiens
cccggggcacccaca

SEQ ID NO: 77372 - DNA, 15 bp, Homo sapiens
ccggggcacccacaa

SEQ ID NO: 77373 - DNA, 15 bp, Homo sapiens
cggggcacccacaac

SEQ ID NO: 77374 - DNA, 15 bp, Homo sapiens
ggggcacccacaact

SEQ ID NO: 77375 - DNA, 15 bp, Homo sapiens
gggcacccacaactt

SEQ ID NO: 77376 - DNA, 15 bp, Homo sapiens
ggcacccacaacttc

SEQ ID NO: 77377 - DNA, 15 bp, Homo sapiens
gcacccacaacttct

SEQ ID NO: 77378 - DNA, 15 bp, Homo sapiens
cacccacaacttctc

SEQ ID NO: 77379 - DNA, 15 bp, Homo sapiens
acccacaacttctcg

SEQ ID NO: 77380 - DNA, 15 bp, Homo sapiens
cccacaacttctcgg

SEQ ID NO: 77381 - DNA, 15 bp, Homo sapiens
ccacaacttctcgga

SEQ ID NO: 77382 - DNA, 15 bp, Homo sapiens
cacaacttctcggag

SEQ ID NO: 77383 - DNA, 15 bp, Homo sapiens
acaacttctcggagg

SEQ ID NO: 77384 - DNA, 15 bp, Homo sapiens
caacttctcggagga

SEQ ID NO: 77385 - DNA, 15 bp, Homo sapiens
aacttctcggaggag

SEQ ID NO: 77386 - DNA, 15 bp, Homo sapiens
acttctcggaggagc

SEQ ID NO: 77387 - DNA, 15 bp, Homo sapiens
cttctcggaggagct

SEQ ID NO: 77388 - DNA, 15 bp, Homo sapiens
ttctcggaggagctc

SEQ ID NO: 77389 - DNA, 15 bp, Homo sapiens
tctcggaggagctca

SEQ ID NO: 77390 - DNA, 15 bp, Homo sapiens
ctcggaggagctcaa

SEQ ID NO: 77391 - DNA, 15 bp, Homo sapiens
tcggaggagctcaag

SEQ ID NO: 77392 - DNA, 15 bp, Homo sapiens
cggaggagctcaaga

SEQ ID NO: 77393 - DNA, 15 bp, Homo sapiens
ggaggagctcaagat

SEQ ID NO: 77394 - DNA, 15 bp, Homo sapiens
gaggagctcaagatc

SEQ ID NO: 77395 - DNA, 15 bp, Homo sapiens
aggagctcaagatcg

SEQ ID NO: 77396 - DNA, 15 bp, Homo sapiens
ggagctcaagatcgg

SEQ ID NO: 77397 - DNA, 15 bp, Homo sapiens
gagctcaagatcggg

SEQ ID NO: 77398 - DNA, 15 bp, Homo sapiens
agctcaagatcgggg

SEQ ID NO: 77399 - DNA, 15 bp, Homo sapiens
gctcaagatcgggga

SEQ ID NO: 77400 - DNA, 15 bp, Homo sapiens
ctcaagatcggggag

SEQ ID NO: 77401 - DNA, 15 bp, Homo sapiens
tcaagatcggggagg

SEQ ID NO: 77402 - DNA, 15 bp, Homo sapiens
caagatcggggaggg

SEQ ID NO: 77403 - DNA, 15 bp, Homo sapiens
aagatcggggagggt

SEQ ID NO: 77404 - DNA, 15 bp, Homo sapiens
agatcggggagggtg

SEQ ID NO: 77405 - DNA, 15 bp, Homo sapiens
gatcggggagggtgg

SEQ ID NO: 77406 - DNA, 15 bp, Homo sapiens
atcggggagggtggc

SEQ ID NO: 77407 - DNA, 15 bp, Homo sapiens
tcggggagggtggct

SEQ ID NO: 77408 - DNA, 15 bp, Homo sapiens
cggggagggtggctt

SEQ ID NO: 77409 - DNA, 15 bp, Homo sapiens
ggggagggtggcttt

SEQ ID NO: 77410 - DNA, 15 bp, Homo sapiens
gggagggtggctttg

SEQ ID NO: 77411 - DNA, 15 bp, Homo sapiens
ggagggtggctttgg

SEQ ID NO: 77412 - DNA, 15 bp, Homo sapiens
gagggtggctttggg

SEQ ID NO: 77413 - DNA, 15 bp, Homo sapiens
agggtggctttgggt

SEQ ID NO: 77414 - DNA, 15 bp, Homo sapiens
gggtggctttgggtg

SEQ ID NO: 77415 - DNA, 15 bp, Homo sapiens
ggtggctttgggtgc

SEQ ID NO: 77416 - DNA, 15 bp, Homo sapiens
gtggctttgggtgcg

SEQ ID NO: 77417 - DNA, 15 bp, Homo sapiens
tggctttgggtgcgt

SEQ ID NO: 77418 - DNA, 15 bp, Homo sapiens
ggctttgggtgcgtg

SEQ ID NO: 77419 - DNA, 15 bp, Homo sapiens
gctttgggtgcgtgt

SEQ ID NO: 77420 - DNA, 15 bp, Homo sapiens
ctttgggtgcgtgta

SEQ ID NO: 77421 - DNA, 15 bp, Homo sapiens
tttgggtgcgtgtac

SEQ ID NO: 77422 - DNA, 15 bp, Homo sapiens
ttgggtgcgtgtacc

SEQ ID NO: 77423 - DNA, 15 bp, Homo sapiens
tgggtgcgtgtaccg

SEQ ID NO: 77424 - DNA, 15 bp, Homo sapiens
gggtgcgtgtaccgg

SEQ ID NO: 77425 - DNA, 15 bp, Homo sapiens
ggtgcgtgtaccggg

SEQ ID NO: 77426 - DNA, 15 bp, Homo sapiens
gtgcgtgtaccgggc

SEQ ID NO: 77427 - DNA, 15 bp, Homo sapiens
tgcgtgtaccgggcg

SEQ ID NO: 77428 - DNA, 15 bp, Homo sapiens
gcgtgtaccgggcgg

SEQ ID NO: 77429 - DNA, 15 bp, Homo sapiens
cgtgtaccgggcggt

SEQ ID NO: 77430 - DNA, 15 bp, Homo sapiens
gtgtaccgggcggtg

SEQ ID NO: 77431 - DNA, 15 bp, Homo sapiens
tgtaccgggcggtga

SEQ ID NO: 77432 - DNA, 15 bp, Homo sapiens
gtaccgggcggtgat

SEQ ID NO: 77433 - DNA, 15 bp, Homo sapiens
taccgggcggtgatg

SEQ ID NO: 77434 - DNA, 15 bp, Homo sapiens
accgggcggtgatga

SEQ ID NO: 77435 - DNA, 15 bp, Homo sapiens
ccgggcggtgatgag

SEQ ID NO: 77436 - DNA, 15 bp, Homo sapiens
cgggcggtgatgagg

SEQ ID NO: 77437 - DNA, 15 bp, Homo sapiens
gggcggtgatgagga

SEQ ID NO: 77438 - DNA, 15 bp, Homo sapiens
ggcggtgatgaggaa

SEQ ID NO: 77439 - DNA, 15 bp, Homo sapiens
gcggtgatgaggaac

SEQ ID NO: 77440 - DNA, 15 bp, Homo sapiens
cggtgatgaggaaca

SEQ ID NO: 77441 - DNA, 15 bp, Homo sapiens
ggtgatgaggaacac

SEQ ID NO: 77442 - DNA, 15 bp, Homo sapiens
gtgatgaggaacacg

SEQ ID NO: 77443 - DNA, 15 bp, Homo sapiens
tgatgaggaacacgg

SEQ ID NO: 77444 - DNA, 15 bp, Homo sapiens
gatgaggaacacggt

SEQ ID NO: 77445 - DNA, 15 bp, Homo sapiens
atgaggaacacggtg

SEQ ID NO: 77446 - DNA, 15 bp, Homo sapiens
tgaggaacacggtgt

SEQ ID NO: 77447 - DNA, 15 bp, Homo sapiens
gaggaacacggtgta

SEQ ID NO: 77448 - DNA, 15 bp, Homo sapiens
aggaacacggtgtat

SEQ ID NO: 77449 - DNA, 15 bp, Homo sapiens
ggaacacggtgtatg

SEQ ID NO: 77450 - DNA, 15 bp, Homo sapiens
gaacacggtgtatgc

SEQ ID NO: 77451 - DNA, 15 bp, Homo sapiens
aacacggtgtatgct

SEQ ID NO: 77452 - DNA, 15 bp, Homo sapiens
acacggtgtatgctg

SEQ ID NO: 77453 - DNA, 15 bp, Homo sapiens
cacggtgtatgctgt

SEQ ID NO: 77454 - DNA, 15 bp, Homo sapiens
acggtgtatgctgtg

SEQ ID NO: 77455 - DNA, 15 bp, Homo sapiens
cggtgtatgctgtga

SEQ ID NO: 77456 - DNA, 15 bp, Homo sapiens
ggtgtatgctgtgaa

SEQ ID NO: 77457 - DNA, 15 bp, Homo sapiens
gtgtatgctgtgaag

SEQ ID NO: 77458 - DNA, 15 bp, Homo sapiens
tgtatgctgtgaaga

SEQ ID NO: 77459 - DNA, 15 bp, Homo sapiens
gtatgctgtgaagag

SEQ ID NO: 77460 - DNA, 15 bp, Homo sapiens
tatgctgtgaagagg

SEQ ID NO: 77461 - DNA, 15 bp, Homo sapiens
atgctgtgaagaggc

SEQ ID NO: 77462 - DNA, 15 bp, Homo sapiens
tgctgtgaagaggct

SEQ ID NO: 77463 - DNA, 15 bp, Homo sapiens
gctgtgaagaggctg

SEQ ID NO: 77464 - DNA, 15 bp, Homo sapiens
ctgtgaagaggctga

SEQ ID NO: 77465 - DNA, 15 bp, Homo sapiens
tgtgaagaggctgaa

SEQ ID NO: 77466 - DNA, 15 bp, Homo sapiens
gtgaagaggctgaag

SEQ ID NO: 77467 - DNA, 15 bp, Homo sapiens
tgaagaggctgaagg

SEQ ID NO: 77468 - DNA, 15 bp, Homo sapiens
gaagaggctgaagga

SEQ ID NO: 77469 - DNA, 15 bp, Homo sapiens
aagaggctgaaggag

SEQ ID NO: 77470 - DNA, 15 bp, Homo sapiens
agaggctgaaggagg

SEQ ID NO: 77471 - DNA, 15 bp, Homo sapiens
gaggctgaaggaggt

SEQ ID NO: 77472 - DNA, 15 bp, Homo sapiens
aggctgaaggaggtg

SEQ ID NO: 77473 - DNA, 15 bp, Homo sapiens
ggctgaaggaggtga

SEQ ID NO: 77474 - DNA, 15 bp, Homo sapiens
gctgaaggaggtgag

SEQ ID NO: 77475 - DNA, 15 bp, Homo sapiens
ctgaaggaggtgagt

SEQ ID NO: 77476 - DNA, 15 bp, Homo sapiens
tgaaggaggtgagtg

SEQ ID NO: 77477 - DNA, 15 bp, Homo sapiens
gaaggaggtgagtgt

SEQ ID NO: 77478 - DNA, 15 bp, Homo sapiens
aaggaggtgagtgtc

SEQ ID NO: 77479 - DNA, 15 bp, Homo sapiens
aggaggtgagtgtcg

SEQ ID NO: 77480 - DNA, 15 bp, Homo sapiens
ggaggtgagtgtcgc

SEQ ID NO: 77481 - DNA, 15 bp, Homo sapiens
gaggtgagtgtcgca

SEQ ID NO: 77482 - DNA, 15 bp, Homo sapiens
aggtgagtgtcgcac

SEQ ID NO: 77483 - DNA, 15 bp, Homo sapiens
ggtgagtgtcgcacc

SEQ ID NO: 77484 - DNA, 15 bp, Homo sapiens
gtgagtgtcgcaccc

SEQ ID NO: 77485 - DNA, 15 bp, Homo sapiens
tgagtgtcgcaccct

SEQ ID NO: 77486 - DNA, 15 bp, Homo sapiens
gagtgtcgcaccctg

SEQ ID NO: 77487 - DNA, 15 bp, Homo sapiens
agtgtcgcaccctgg

SEQ ID NO: 77488 - DNA, 15 bp, Homo sapiens
gtgtcgcaccctggc

SEQ ID NO: 77489 - DNA, 15 bp, Homo sapiens
tgtcgcaccctggca

SEQ ID NO: 77490 - DNA, 15 bp, Homo sapiens
gtcgcaccctggcag

SEQ ID NO: 77491 - DNA, 15 bp, Homo sapiens
tcgcaccctggcagg

SEQ ID NO: 77492 - DNA, 15 bp, Homo sapiens
cgcaccctggcaggg

SEQ ID NO: 77493 - DNA, 15 bp, Homo sapiens
gcaccctggcaggga

SEQ ID NO: 77494 - DNA, 15 bp, Homo sapiens
caccctggcagggac

SEQ ID NO: 77495 - DNA, 15 bp, Homo sapiens
accctggcagggacc

SEQ ID NO: 77496 - DNA, 15 bp, Homo sapiens
ccctggcagggaccc

SEQ ID NO: 77497 - DNA, 15 bp, Homo sapiens
cctggcagggaccct

SEQ ID NO: 77498 - DNA, 15 bp, Homo sapiens
ctggcagggaccctg

SEQ ID NO: 77499 - DNA, 15 bp, Homo sapiens
tggcagggaccctgg

SEQ ID NO: 77500 - DNA, 15 bp, Homo sapiens
ggcagggaccctgga

SEQ ID NO: 77501 - DNA, 15 bp, Homo sapiens
gcagggaccctggaa

SEQ ID NO: 77502 - DNA, 15 bp, Homo sapiens
cagggaccctggaag

SEQ ID NO: 77503 - DNA, 15 bp, Homo sapiens
agggaccctggaagg

SEQ ID NO: 77504 - DNA, 15 bp, Homo sapiens
gggaccctggaaggc

SEQ ID NO: 77505 - DNA, 15 bp, Homo sapiens
ggaccctggaaggcc

SEQ ID NO: 77506 - DNA, 15 bp, Homo sapiens
gaccctggaaggcca

SEQ ID NO: 77507 - DNA, 15 bp, Homo sapiens
accctggaaggccat

SEQ ID NO: 77508 - DNA, 15 bp, Homo sapiens
ccctggaaggccatc

SEQ ID NO: 77509 - DNA, 15 bp, Homo sapiens
cctggaaggccatca

SEQ ID NO: 77510 - DNA, 15 bp, Homo sapiens
ctggaaggccatcag

SEQ ID NO: 77511 - DNA, 15 bp, Homo sapiens
tggaaggccatcaga

SEQ ID NO: 77512 - DNA, 15 bp, Homo sapiens
ggaaggccatcagat

SEQ ID NO: 77513 - DNA, 15 bp, Homo sapiens
gaaggccatcagata

SEQ ID NO: 77514 - DNA, 15 bp, Homo sapiens
aaggccatcagataa

SEQ ID NO: 77515 - DNA, 15 bp, Homo sapiens
aggccatcagataac

SEQ ID NO: 77516 - DNA, 15 bp, Homo sapiens
ggccatcagataacc

SEQ ID NO: 77517 - DNA, 15 bp, Homo sapiens
gccatcagataaccc

SEQ ID NO: 77518 - DNA, 15 bp, Homo sapiens
ccatcagataaccct

SEQ ID NO: 77519 - DNA, 15 bp, Homo sapiens
catcagataaccctc

SEQ ID NO: 77520 - DNA, 15 bp, Homo sapiens
atcagataaccctca

SEQ ID NO: 77521 - DNA, 15 bp, Homo sapiens
tcagataaccctcac

SEQ ID NO: 77522 - DNA, 15 bp, Homo sapiens
cagataaccctcacc

SEQ ID NO: 77523 - DNA, 15 bp, Homo sapiens
agataaccctcacca

SEQ ID NO: 77524 - DNA, 15 bp, Homo sapiens
gataaccctcaccac

SEQ ID NO: 77525 - DNA, 15 bp, Homo sapiens
ataaccctcaccact

SEQ ID NO: 77526 - DNA, 15 bp, Homo sapiens
taaccctcaccactt

SEQ ID NO: 77527 - DNA, 15 bp, Homo sapiens
aaccctcaccacttc

SEQ ID NO: 77528 - DNA, 15 bp, Homo sapiens
accctcaccacttct

SEQ ID NO: 77529 - DNA, 15 bp, Homo sapiens
ccctcaccacttctc

SEQ ID NO: 77530 - DNA, 15 bp, Homo sapiens
cctcaccacttctcc

SEQ ID NO: 77531 - DNA, 15 bp, Homo sapiens
ctcaccacttctcca

SEQ ID NO: 77532 - DNA, 15 bp, Homo sapiens
tcaccacttctccag

SEQ ID NO: 77533 - DNA, 15 bp, Homo sapiens
caccacttctccagc

SEQ ID NO: 77534 - DNA, 15 bp, Homo sapiens
accacttctccagcc

SEQ ID NO: 77535 - DNA, 15 bp, Homo sapiens
ccacttctccagcct

SEQ ID NO: 77536 - DNA, 15 bp, Homo sapiens
cacttctccagcctt

SEQ ID NO: 77537 - DNA, 15 bp, Homo sapiens
acttctccagccttt

SEQ ID NO: 77538 - DNA, 15 bp, Homo sapiens
cttctccagcctttc

SEQ ID NO: 77539 - DNA, 15 bp, Homo sapiens
ttctccagcctttcc

SEQ ID NO: 77540 - DNA, 15 bp, Homo sapiens
tctccagcctttccc

SEQ ID NO: 77541 - DNA, 15 bp, Homo sapiens
ctccagcctttcccc

SEQ ID NO: 77542 - DNA, 15 bp, Homo sapiens
tccagcctttccccc

SEQ ID NO: 77543 - DNA, 15 bp, Homo sapiens
ccagcctttccccct

SEQ ID NO: 77544 - DNA, 15 bp, Homo sapiens
cagcctttccccctc

SEQ ID NO: 77545 - DNA, 15 bp, Homo sapiens
agcctttccccctcg

SEQ ID NO: 77546 - DNA, 15 bp, Homo sapiens
gcctttccccctcgc

SEQ ID NO: 77547 - DNA, 15 bp, Homo sapiens
cctttccccctcgct

SEQ ID NO: 77548 - DNA, 15 bp, Homo sapiens
ctttccccctcgctt

SEQ ID NO: 77549 - DNA, 15 bp, Homo sapiens
tttccccctcgcttc

SEQ ID NO: 77550 - DNA, 15 bp, Homo sapiens
ttccccctcgcttcc

SEQ ID NO: 77551 - DNA, 15 bp, Homo sapiens
tccccctcgcttccc

SEQ ID NO: 77552 - DNA, 15 bp, Homo sapiens
ccccctcgcttcccc

SEQ ID NO: 77553 - DNA, 15 bp, Homo sapiens
cccctcgcttcccca

SEQ ID NO: 77554 - DNA, 15 bp, Homo sapiens
ccctcgcttccccac

SEQ ID NO: 77555 - DNA, 15 bp, Homo sapiens
cctcgcttccccaca

SEQ ID NO: 77556 - DNA, 15 bp, Homo sapiens
ctcgcttccccacac

SEQ ID NO: 77557 - DNA, 15 bp, Homo sapiens
tcgcttccccacaca

SEQ ID NO: 77558 - DNA, 15 bp, Homo sapiens
cgcttccccacacaa

SEQ ID NO: 77559 - DNA, 15 bp, Homo sapiens
gcttccccacacaac

SEQ ID NO: 77560 - DNA, 15 bp, Homo sapiens
cttccccacacaact

SEQ ID NO: 77561 - DNA, 15 bp, Homo sapiens
ttccccacacaactc

SEQ ID NO: 77562 - DNA, 15 bp, Homo sapiens
tccccacacaactcc

SEQ ID NO: 77563 - DNA, 15 bp, Homo sapiens
ccccacacaactcct

SEQ ID NO: 77564 - DNA, 15 bp, Homo sapiens
cccacacaactcctt

SEQ ID NO: 77565 - DNA, 15 bp, Homo sapiens
ccacacaactccttc

SEQ ID NO: 77566 - DNA, 15 bp, Homo sapiens
cacacaactccttca

SEQ ID NO: 77567 - DNA, 15 bp, Homo sapiens
acacaactccttcag

SEQ ID NO: 77568 - DNA, 15 bp, Homo sapiens
cacaactccttcagc

SEQ ID NO: 77569 - DNA, 15 bp, Homo sapiens
acaactccttcagcc

SEQ ID NO: 77570 - DNA, 15 bp, Homo sapiens
caactccttcagccc

SEQ ID NO: 77571 - DNA, 15 bp, Homo sapiens
aactccttcagccct

SEQ ID NO: 77572 - DNA, 15 bp, Homo sapiens
actccttcagccctc

SEQ ID NO: 77573 - DNA, 15 bp, Homo sapiens
ctccttcagccctca

SEQ ID NO: 77574 - DNA, 15 bp, Homo sapiens
tccttcagccctcat

SEQ ID NO: 77575 - DNA, 15 bp, Homo sapiens
ccttcagccctcatt

SEQ ID NO: 77576 - DNA, 15 bp, Homo sapiens
cttcagccctcattc

SEQ ID NO: 77577 - DNA, 15 bp, Homo sapiens
ttcagccctcattct

SEQ ID NO: 77578 - DNA, 15 bp, Homo sapiens
tcagccctcattctg

SEQ ID NO: 77579 - DNA, 15 bp, Homo sapiens
cagccctcattctgg

SEQ ID NO: 77580 - DNA, 15 bp, Homo sapiens
agccctcattctggc

SEQ ID NO: 77581 - DNA, 15 bp, Homo sapiens
gccctcattctggcg

SEQ ID NO: 77582 - DNA, 15 bp, Homo sapiens
ccctcattctggcgt

SEQ ID NO: 77583 - DNA, 15 bp, Homo sapiens
cctcattctggcgta

SEQ ID NO: 77584 - DNA, 15 bp, Homo sapiens
ctcattctggcgtag

SEQ ID NO: 77585 - DNA, 15 bp, Homo sapiens
tcattctggcgtagg

SEQ ID NO: 77586 - DNA, 15 bp, Homo sapiens
cattctggcgtaggg

SEQ ID NO: 77587 - DNA, 15 bp, Homo sapiens
attctggcgtagggt

SEQ ID NO: 77588 - DNA, 15 bp, Homo sapiens
ttctggcgtagggtc

SEQ ID NO: 77589 - DNA, 15 bp, Homo sapiens
tctggcgtagggtcc

SEQ ID NO: 77590 - DNA, 15 bp, Homo sapiens
ctggcgtagggtccc

SEQ ID NO: 77591 - DNA, 15 bp, Homo sapiens
tggcgtagggtccct

SEQ ID NO: 77592 - DNA, 15 bp, Homo sapiens
ggcgtagggtccctg

SEQ ID NO: 77593 - DNA, 15 bp, Homo sapiens
gcgtagggtccctgg

SEQ ID NO: 77594 - DNA, 15 bp, Homo sapiens
cgtagggtccctggc

SEQ ID NO: 77595 - DNA, 15 bp, Homo sapiens
gtagggtccctggcc

SEQ ID NO: 77596 - DNA, 15 bp, Homo sapiens
tagggtccctggccc

SEQ ID NO: 77597 - DNA, 15 bp, Homo sapiens
agggtccctggcccc

SEQ ID NO: 77598 - DNA, 15 bp, Homo sapiens
gggtccctggcccct

SEQ ID NO: 77599 - DNA, 15 bp, Homo sapiens
ggtccctggcccctt

SEQ ID NO: 77600 - DNA, 15 bp, Homo sapiens
gtccctggccccttg

SEQ ID NO: 77601 - DNA, 15 bp, Homo sapiens
tccctggccccttgg

SEQ ID NO: 77602 - DNA, 15 bp, Homo sapiens
ccctggccccttggt

SEQ ID NO: 77603 - DNA, 15 bp, Homo sapiens
cctggccccttggtg

SEQ ID NO: 77604 - DNA, 15 bp, Homo sapiens
ctggccccttggtgg

SEQ ID NO: 77605 - DNA, 15 bp, Homo sapiens
tggccccttggtggt

SEQ ID NO: 77606 - DNA, 15 bp, Homo sapiens
ggccccttggtggtt

SEQ ID NO: 77607 - DNA, 15 bp, Homo sapiens
gccccttggtggttc

SEQ ID NO: 77608 - DNA, 15 bp, Homo sapiens
ccccttggtggttct

SEQ ID NO: 77609 - DNA, 15 bp, Homo sapiens
cccttggtggttctg

SEQ ID NO: 77610 - DNA, 15 bp, Homo sapiens
ccttggtggttctgg

SEQ ID NO: 77611 - DNA, 15 bp, Homo sapiens
cttggtggttctggg

SEQ ID NO: 77612 - DNA, 15 bp, Homo sapiens
ttggtggttctgggc

SEQ ID NO: 77613 - DNA, 15 bp, Homo sapiens
tggtggttctgggcc

SEQ ID NO: 77614 - DNA, 15 bp, Homo sapiens
ggtggttctgggcct

SEQ ID NO: 77615 - DNA, 15 bp, Homo sapiens
gtggttctgggcctc

SEQ ID NO: 77616 - DNA, 15 bp, Homo sapiens
tggttctgggcctcg

SEQ ID NO: 77617 - DNA, 15 bp, Homo sapiens
ggttctgggcctcgg

SEQ ID NO: 77618 - DNA, 15 bp, Homo sapiens
gttctgggcctcggg

SEQ ID NO: 77619 - DNA, 15 bp, Homo sapiens
ttctgggcctcgggt

SEQ ID NO: 77620 - DNA, 15 bp, Homo sapiens
tctgggcctcgggta

SEQ ID NO: 77621 - DNA, 15 bp, Homo sapiens
ctgggcctcgggtag

SEQ ID NO: 77622 - DNA, 15 bp, Homo sapiens
tgggcctcgggtagg

SEQ ID NO: 77623 - DNA, 15 bp, Homo sapiens
gggcctcgggtaggt

SEQ ID NO: 77624 - DNA, 15 bp, Homo sapiens
ggcctcgggtaggtg

SEQ ID NO: 77625 - DNA, 15 bp, Homo sapiens
gcctcgggtaggtgg

SEQ ID NO: 77626 - DNA, 15 bp, Homo sapiens
cctcgggtaggtggc

SEQ ID NO: 77627 - DNA, 15 bp, Homo sapiens
ctcgggtaggtggca

SEQ ID NO: 77628 - DNA, 15 bp, Homo sapiens
tcgggtaggtggcac

SEQ ID NO: 77629 - DNA, 15 bp, Homo sapiens
cgggtaggtggcact

SEQ ID NO: 77630 - DNA, 15 bp, Homo sapiens
gggtaggtggcactg

SEQ ID NO: 77631 - DNA, 15 bp, Homo sapiens
ggtaggtggcactgg

SEQ ID NO: 77632 - DNA, 15 bp, Homo sapiens
gtaggtggcactggt

SEQ ID NO: 77633 - DNA, 15 bp, Homo sapiens
taggtggcactggtg

SEQ ID NO: 77634 - DNA, 15 bp, Homo sapiens
aggtggcactggtgg

SEQ ID NO: 77635 - DNA, 15 bp, Homo sapiens
ggtggcactggtggc

SEQ ID NO: 77636 - DNA, 15 bp, Homo sapiens
gtggcactggtggcc

SEQ ID NO: 77637 - DNA, 15 bp, Homo sapiens
tggcactggtggccc

SEQ ID NO: 77638 - DNA, 15 bp, Homo sapiens
ggcactggtggcccg

SEQ ID NO: 77639 - DNA, 15 bp, Homo sapiens
gcactggtggcccga

SEQ ID NO: 77640 - DNA, 15 bp, Homo sapiens
cactggtggcccgaa

SEQ ID NO: 77641 - DNA, 15 bp, Homo sapiens
actggtggcccgaag

SEQ ID NO: 77642 - DNA, 15 bp, Homo sapiens
ctggtggcccgaagg

SEQ ID NO: 77643 - DNA, 15 bp, Homo sapiens
tggtggcccgaaggc

SEQ ID NO: 77644 - DNA, 15 bp, Homo sapiens
ggtggcccgaaggcc

SEQ ID NO: 77645 - DNA, 15 bp, Homo sapiens
gtggcccgaaggcct

SEQ ID NO: 77646 - DNA, 15 bp, Homo sapiens
tggcccgaaggcctt

SEQ ID NO: 77647 - DNA, 15 bp, Homo sapiens
ggcccgaaggccttc

SEQ ID NO: 77648 - DNA, 15 bp, Homo sapiens
gcccgaaggccttcg

SEQ ID NO: 77649 - DNA, 15 bp, Homo sapiens
cccgaaggccttcgc

SEQ ID NO: 77650 - DNA, 15 bp, Homo sapiens
ccgaaggccttcgct

SEQ ID NO: 77651 - DNA, 15 bp, Homo sapiens
cgaaggccttcgctt

SEQ ID NO: 77652 - DNA, 15 bp, Homo sapiens
gaaggccttcgcttc

SEQ ID NO: 77653 - DNA, 15 bp, Homo sapiens
aaggccttcgcttcg

SEQ ID NO: 77654 - DNA, 15 bp, Homo sapiens
aggccttcgcttcga

SEQ ID NO: 77655 - DNA, 15 bp, Homo sapiens
ggccttcgcttcgag

SEQ ID NO: 77656 - DNA, 15 bp, Homo sapiens
gccttcgcttcgaga

SEQ ID NO: 77657 - DNA, 15 bp, Homo sapiens
ccttcgcttcgagag

SEQ ID NO: 77658 - DNA, 15 bp, Homo sapiens
cttcgcttcgagagc

SEQ ID NO: 77659 - DNA, 15 bp, Homo sapiens
ttcgcttcgagagcc

SEQ ID NO: 77660 - DNA, 15 bp, Homo sapiens
tcgcttcgagagcct

SEQ ID NO: 77661 - DNA, 15 bp, Homo sapiens
cgcttcgagagcctc

SEQ ID NO: 77662 - DNA, 15 bp, Homo sapiens
gcttcgagagcctca

SEQ ID NO: 77663 - DNA, 15 bp, Homo sapiens
cttcgagagcctcac

SEQ ID NO: 77664 - DNA, 15 bp, Homo sapiens
ttcgagagcctcacg

SEQ ID NO: 77665 - DNA, 15 bp, Homo sapiens
tcgagagcctcacgc

SEQ ID NO: 77666 - DNA, 15 bp, Homo sapiens
cgagagcctcacgct

SEQ ID NO: 77667 - DNA, 15 bp, Homo sapiens
gagagcctcacgctg

SEQ ID NO: 77668 - DNA, 15 bp, Homo sapiens
agagcctcacgctgc

SEQ ID NO: 77669 - DNA, 15 bp, Homo sapiens
gagcctcacgctgcc

SEQ ID NO: 77670 - DNA, 15 bp, Homo sapiens
agcctcacgctgccc

SEQ ID NO: 77671 - DNA, 15 bp, Homo sapiens
gcctcacgctgcccg

SEQ ID NO: 77672 - DNA, 15 bp, Homo sapiens
cctcacgctgcccgt

SEQ ID NO: 77673 - DNA, 15 bp, Homo sapiens
ctcacgctgcccgtc

SEQ ID NO: 77674 - DNA, 15 bp, Homo sapiens
tcacgctgcccgtct

SEQ ID NO: 77675 - DNA, 15 bp, Homo sapiens
cacgctgcccgtctt

SEQ ID NO: 77676 - DNA, 15 bp, Homo sapiens
acgctgcccgtcttc

SEQ ID NO: 77677 - DNA, 15 bp, Homo sapiens
cgctgcccgtcttcc

SEQ ID NO: 77678 - DNA, 15 bp, Homo sapiens
gctgcccgtcttccc

SEQ ID NO: 77679 - DNA, 15 bp, Homo sapiens
ctgcccgtcttccct

SEQ ID NO: 77680 - DNA, 15 bp, Homo sapiens
tgcccgtcttccctg

SEQ ID NO: 77681 - DNA, 15 bp, Homo sapiens
gcccgtcttccctgc

SEQ ID NO: 77682 - DNA, 15 bp, Homo sapiens
cccgtcttccctgcc

SEQ ID NO: 77683 - DNA, 15 bp, Homo sapiens
ccgtcttccctgccc

SEQ ID NO: 77684 - DNA, 15 bp, Homo sapiens
cgtcttccctgcccc

SEQ ID NO: 77685 - DNA, 15 bp, Homo sapiens
gtcttccctgcccct

SEQ ID NO: 77686 - DNA, 15 bp, Homo sapiens
tcttccctgcccctt

SEQ ID NO: 77687 - DNA, 15 bp, Homo sapiens
cttccctgccccttc

SEQ ID NO: 77688 - DNA, 15 bp, Homo sapiens
ttccctgccccttcc

SEQ ID NO: 77689 - DNA, 15 bp, Homo sapiens
tccctgccccttccc

SEQ ID NO: 77690 - DNA, 15 bp, Homo sapiens
ccctgccccttcccc

SEQ ID NO: 77691 - DNA, 15 bp, Homo sapiens
cctgccccttccccc

SEQ ID NO: 77692 - DNA, 15 bp, Homo sapiens
ctgccccttccccca

SEQ ID NO: 77693 - DNA, 15 bp, Homo sapiens
tgccccttcccccac

SEQ ID NO: 77694 - DNA, 15 bp, Homo sapiens
gccccttcccccacc

SEQ ID NO: 77695 - DNA, 15 bp, Homo sapiens
ccccttcccccaccg

SEQ ID NO: 77696 - DNA, 15 bp, Homo sapiens
cccttcccccaccgc

SEQ ID NO: 77697 - DNA, 15 bp, Homo sapiens
ccttcccccaccgca

SEQ ID NO: 77698 - DNA, 15 bp, Homo sapiens
cttcccccaccgcac

SEQ ID NO: 77699 - DNA, 15 bp, Homo sapiens
ttcccccaccgcacc

SEQ ID NO: 77700 - DNA, 15 bp, Homo sapiens
tcccccaccgcaccc

SEQ ID NO: 77701 - DNA, 15 bp, Homo sapiens
cccccaccgcaccct

SEQ ID NO: 77702 - DNA, 15 bp, Homo sapiens
ccccaccgcaccctg

SEQ ID NO: 77703 - DNA, 15 bp, Homo sapiens
cccaccgcaccctgg

SEQ ID NO: 77704 - DNA, 15 bp, Homo sapiens
ccaccgcaccctggg

SEQ ID NO: 77705 - DNA, 15 bp, Homo sapiens
caccgcaccctgggg

SEQ ID NO: 77706 - DNA, 15 bp, Homo sapiens
accgcaccctggggg

SEQ ID NO: 77707 - DNA, 15 bp, Homo sapiens
ccgcaccctgggggc

SEQ ID NO: 77708 - DNA, 15 bp, Homo sapiens
cgcaccctgggggct

SEQ ID NO: 77709 - DNA, 15 bp, Homo sapiens
gcaccctgggggctg

SEQ ID NO: 77710 - DNA, 15 bp, Homo sapiens
caccctgggggctgc

SEQ ID NO: 77711 - DNA, 15 bp, Homo sapiens
accctgggggctgca

SEQ ID NO: 77712 - DNA, 15 bp, Homo sapiens
ccctgggggctgcag

SEQ ID NO: 77713 - DNA, 15 bp, Homo sapiens
cctgggggctgcaga

SEQ ID NO: 77714 - DNA, 15 bp, Homo sapiens
ctgggggctgcagaa

SEQ ID NO: 77715 - DNA, 15 bp, Homo sapiens
tgggggctgcagaac

SEQ ID NO: 77716 - DNA, 15 bp, Homo sapiens
gggggctgcagaacg

SEQ ID NO: 77717 - DNA, 15 bp, Homo sapiens
ggggctgcagaacgc

SEQ ID NO: 77718 - DNA, 15 bp, Homo sapiens
gggctgcagaacgct

SEQ ID NO: 77719 - DNA, 15 bp, Homo sapiens
ggctgcagaacgctg

SEQ ID NO: 77720 - DNA, 15 bp, Homo sapiens
gctgcagaacgctga

SEQ ID NO: 77721 - DNA, 15 bp, Homo sapiens
ctgcagaacgctgac

SEQ ID NO: 77722 - DNA, 15 bp, Homo sapiens
tgcagaacgctgacc

SEQ ID NO: 77723 - DNA, 15 bp, Homo sapiens
gcagaacgctgacct

SEQ ID NO: 77724 - DNA, 15 bp, Homo sapiens
cagaacgctgacctg

SEQ ID NO: 77725 - DNA, 15 bp, Homo sapiens
agaacgctgacctgg

SEQ ID NO: 77726 - DNA, 15 bp, Homo sapiens
gaacgctgacctgga

SEQ ID NO: 77727 - DNA, 15 bp, Homo sapiens
aacgctgacctggag

SEQ ID NO: 77728 - DNA, 15 bp, Homo sapiens
acgctgacctggagt

SEQ ID NO: 77729 - DNA, 15 bp, Homo sapiens
cgctgacctggagtg

SEQ ID NO: 77730 - DNA, 15 bp, Homo sapiens
gctgacctggagtgg

SEQ ID NO: 77731 - DNA, 15 bp, Homo sapiens
ctgacctggagtgga

SEQ ID NO: 77732 - DNA, 15 bp, Homo sapiens
tgacctggagtggac

SEQ ID NO: 77733 - DNA, 15 bp, Homo sapiens
gacctggagtggact

SEQ ID NO: 77734 - DNA, 15 bp, Homo sapiens
acctggagtggactg

SEQ ID NO: 77735 - DNA, 15 bp, Homo sapiens
cctggagtggactgc

SEQ ID NO: 77736 - DNA, 15 bp, Homo sapiens
ctggagtggactgca

SEQ ID NO: 77737 - DNA, 15 bp, Homo sapiens
tggagtggactgcag

SEQ ID NO: 77738 - DNA, 15 bp, Homo sapiens
ggagtggactgcagt

SEQ ID NO: 77739 - DNA, 15 bp, Homo sapiens
gagtggactgcagtg

SEQ ID NO: 77740 - DNA, 15 bp, Homo sapiens
agtggactgcagtga

SEQ ID NO: 77741 - DNA, 15 bp, Homo sapiens
gtggactgcagtgaa

SEQ ID NO: 77742 - DNA, 15 bp, Homo sapiens
tggactgcagtgaag

SEQ ID NO: 77743 - DNA, 15 bp, Homo sapiens
ggactgcagtgaagc

SEQ ID NO: 77744 - DNA, 15 bp, Homo sapiens
gactgcagtgaagca

SEQ ID NO: 77745 - DNA, 15 bp, Homo sapiens
actgcagtgaagcag

SEQ ID NO: 77746 - DNA, 15 bp, Homo sapiens
ctgcagtgaagcaga

SEQ ID NO: 77747 - DNA, 15 bp, Homo sapiens
tgcagtgaagcagag

SEQ ID NO: 77748 - DNA, 15 bp, Homo sapiens
gcagtgaagcagagc

SEQ ID NO: 77749 - DNA, 15 bp, Homo sapiens
cagtgaagcagagct

SEQ ID NO: 77750 - DNA, 15 bp, Homo sapiens
agtgaagcagagctt

SEQ ID NO: 77751 - DNA, 15 bp, Homo sapiens
gtgaagcagagcttc

SEQ ID NO: 77752 - DNA, 15 bp, Homo sapiens
tgaagcagagcttcc

SEQ ID NO: 77753 - DNA, 15 bp, Homo sapiens
gaagcagagcttcct

SEQ ID NO: 77754 - DNA, 15 bp, Homo sapiens
aagcagagcttcctg

SEQ ID NO: 77755 - DNA, 15 bp, Homo sapiens
agcagagcttcctga

SEQ ID NO: 77756 - DNA, 15 bp, Homo sapiens
gcagagcttcctgac

SEQ ID NO: 77757 - DNA, 15 bp, Homo sapiens
cagagcttcctgacc

SEQ ID NO: 77758 - DNA, 15 bp, Homo sapiens
agagcttcctgaccg

SEQ ID NO: 77759 - DNA, 15 bp, Homo sapiens
gagcttcctgaccga

SEQ ID NO: 77760 - DNA, 15 bp, Homo sapiens
agcttcctgaccgag

SEQ ID NO: 77761 - DNA, 15 bp, Homo sapiens
gcttcctgaccgagg

SEQ ID NO: 77762 - DNA, 15 bp, Homo sapiens
cttcctgaccgaggt

SEQ ID NO: 77763 - DNA, 15 bp, Homo sapiens
ttcctgaccgaggtg

SEQ ID NO: 77764 - DNA, 15 bp, Homo sapiens
tcctgaccgaggtgg

SEQ ID NO: 77765 - DNA, 15 bp, Homo sapiens
cctgaccgaggtgga

SEQ ID NO: 77766 - DNA, 15 bp, Homo sapiens
ctgaccgaggtggag

SEQ ID NO: 77767 - DNA, 15 bp, Homo sapiens
tgaccgaggtggagc

SEQ ID NO: 77768 - DNA, 15 bp, Homo sapiens
gaccgaggtggagca

SEQ ID NO: 77769 - DNA, 15 bp, Homo sapiens
accgaggtggagcag

SEQ ID NO: 77770 - DNA, 15 bp, Homo sapiens
ccgaggtggagcagc

SEQ ID NO: 77771 - DNA, 15 bp, Homo sapiens
cgaggtggagcagct

SEQ ID NO: 77772 - DNA, 15 bp, Homo sapiens
gaggtggagcagctg

SEQ ID NO: 77773 - DNA, 15 bp, Homo sapiens
aggtggagcagctgt

SEQ ID NO: 77774 - DNA, 15 bp, Homo sapiens
ggtggagcagctgtc

SEQ ID NO: 77775 - DNA, 15 bp, Homo sapiens
gtggagcagctgtcc

SEQ ID NO: 77776 - DNA, 15 bp, Homo sapiens
tggagcagctgtcca

SEQ ID NO: 77777 - DNA, 15 bp, Homo sapiens
ggagcagctgtccag

SEQ ID NO: 77778 - DNA, 15 bp, Homo sapiens
gagcagctgtccagg

SEQ ID NO: 77779 - DNA, 15 bp, Homo sapiens
agcagctgtccaggt

SEQ ID NO: 77780 - DNA, 15 bp, Homo sapiens
gcagctgtccaggtg

SEQ ID NO: 77781 - DNA, 15 bp, Homo sapiens
cagctgtccaggtga

SEQ ID NO: 77782 - DNA, 15 bp, Homo sapiens
agctgtccaggtgag

SEQ ID NO: 77783 - DNA, 15 bp, Homo sapiens
gctgtccaggtgagg

SEQ ID NO: 77784 - DNA, 15 bp, Homo sapiens
ctgtccaggtgaggc

SEQ ID NO: 77785 - DNA, 15 bp, Homo sapiens
tgtccaggtgaggcc

SEQ ID NO: 77786 - DNA, 15 bp, Homo sapiens
gtccaggtgaggcca

SEQ ID NO: 77787 - DNA, 15 bp, Homo sapiens
tccaggtgaggccag

SEQ ID NO: 77788 - DNA, 15 bp, Homo sapiens
ccaggtgaggccaga

SEQ ID NO: 77789 - DNA, 15 bp, Homo sapiens
caggtgaggccagag

SEQ ID NO: 77790 - DNA, 15 bp, Homo sapiens
aggtgaggccagagg

SEQ ID NO: 77791 - DNA, 15 bp, Homo sapiens
ggtgaggccagaggg

SEQ ID NO: 77792 - DNA, 15 bp, Homo sapiens
gtgaggccagagggg

SEQ ID NO: 77793 - DNA, 15 bp, Homo sapiens
tgaggccagaggggg

SEQ ID NO: 77794 - DNA, 15 bp, Homo sapiens
gaggccagaggggga

SEQ ID NO: 77795 - DNA, 15 bp, Homo sapiens
aggccagagggggag

SEQ ID NO: 77796 - DNA, 15 bp, Homo sapiens
ggccagagggggagc

SEQ ID NO: 77797 - DNA, 15 bp, Homo sapiens
gccagagggggagcc

SEQ ID NO: 77798 - DNA, 15 bp, Homo sapiens
ccagagggggagcca

SEQ ID NO: 77799 - DNA, 15 bp, Homo sapiens
cagagggggagccac

SEQ ID NO: 77800 - DNA, 15 bp, Homo sapiens
agagggggagccaca

SEQ ID NO: 77801 - DNA, 15 bp, Homo sapiens
gagggggagccacac

SEQ ID NO: 77802 - DNA, 15 bp, Homo sapiens
agggggagccacacc

SEQ ID NO: 77803 - DNA, 15 bp, Homo sapiens
gggggagccacacca

SEQ ID NO: 77804 - DNA, 15 bp, Homo sapiens
ggggagccacaccag

SEQ ID NO: 77805 - DNA, 15 bp, Homo sapiens
gggagccacaccagg

SEQ ID NO: 77806 - DNA, 15 bp, Homo sapiens
ggagccacaccaggt

SEQ ID NO: 77807 - DNA, 15 bp, Homo sapiens
gagccacaccaggtc

SEQ ID NO: 77808 - DNA, 15 bp, Homo sapiens
agccacaccaggtcc

SEQ ID NO: 77809 - DNA, 15 bp, Homo sapiens
gccacaccaggtccc

SEQ ID NO: 77810 - DNA, 15 bp, Homo sapiens
ccacaccaggtcccg

SEQ ID NO: 77811 - DNA, 15 bp, Homo sapiens
cacaccaggtcccgt

SEQ ID NO: 77812 - DNA, 15 bp, Homo sapiens
acaccaggtcccgtg

SEQ ID NO: 77813 - DNA, 15 bp, Homo sapiens
caccaggtcccgtgg

SEQ ID NO: 77814 - DNA, 15 bp, Homo sapiens
accaggtcccgtggg

SEQ ID NO: 77815 - DNA, 15 bp, Homo sapiens
ccaggtcccgtgggg

SEQ ID NO: 77816 - DNA, 15 bp, Homo sapiens
caggtcccgtggggc

SEQ ID NO: 77817 - DNA, 15 bp, Homo sapiens
aggtcccgtggggct

SEQ ID NO: 77818 - DNA, 15 bp, Homo sapiens
ggtcccgtggggctt

SEQ ID NO: 77819 - DNA, 15 bp, Homo sapiens
gtcccgtggggcttc

SEQ ID NO: 77820 - DNA, 15 bp, Homo sapiens
tcccgtggggcttca

SEQ ID NO: 77821 - DNA, 15 bp, Homo sapiens
cccgtggggcttcag

SEQ ID NO: 77822 - DNA, 15 bp, Homo sapiens
ccgtggggcttcaga

SEQ ID NO: 77823 - DNA, 15 bp, Homo sapiens
cgtggggcttcagac

SEQ ID NO: 77824 - DNA, 15 bp, Homo sapiens
gtggggcttcagacc

SEQ ID NO: 77825 - DNA, 15 bp, Homo sapiens
tggggcttcagaccg

SEQ ID NO: 77826 - DNA, 15 bp, Homo sapiens
ggggcttcagaccgc

SEQ ID NO: 77827 - DNA, 15 bp, Homo sapiens
gggcttcagaccgca

SEQ ID NO: 77828 - DNA, 15 bp, Homo sapiens
ggcttcagaccgcac

SEQ ID NO: 77829 - DNA, 15 bp, Homo sapiens
gcttcagaccgcaca

SEQ ID NO: 77830 - DNA, 15 bp, Homo sapiens
cttcagaccgcacac

SEQ ID NO: 77831 - DNA, 15 bp, Homo sapiens
ttcagaccgcacacc

SEQ ID NO: 77832 - DNA, 15 bp, Homo sapiens
tcagaccgcacacca

SEQ ID NO: 77833 - DNA, 15 bp, Homo sapiens
cagaccgcacaccac

SEQ ID NO: 77834 - DNA, 15 bp, Homo sapiens
agaccgcacaccaca

SEQ ID NO: 77835 - DNA, 15 bp, Homo sapiens
gaccgcacaccacag

SEQ ID NO: 77836 - DNA, 15 bp, Homo sapiens
accgcacaccacagg

SEQ ID NO: 77837 - DNA, 15 bp, Homo sapiens
ccgcacaccacagga

SEQ ID NO: 77838 - DNA, 15 bp, Homo sapiens
cgcacaccacaggac

SEQ ID NO: 77839 - DNA, 15 bp, Homo sapiens
gcacaccacaggacc

SEQ ID NO: 77840 - DNA, 15 bp, Homo sapiens
cacaccacaggacct

SEQ ID NO: 77841 - DNA, 15 bp, Homo sapiens
acaccacaggacctg

SEQ ID NO: 77842 - DNA, 15 bp, Homo sapiens
caccacaggacctgg

SEQ ID NO: 77843 - DNA, 15 bp, Homo sapiens
accacaggacctggc

SEQ ID NO: 77844 - DNA, 15 bp, Homo sapiens
ccacaggacctggct

SEQ ID NO: 77845 - DNA, 15 bp, Homo sapiens
cacaggacctggctc

SEQ ID NO: 77846 - DNA, 15 bp, Homo sapiens
acaggacctggctcc

SEQ ID NO: 77847 - DNA, 15 bp, Homo sapiens
caggacctggctccc

SEQ ID NO: 77848 - DNA, 15 bp, Homo sapiens
aggacctggctccct

SEQ ID NO: 77849 - DNA, 15 bp, Homo sapiens
ggacctggctccctt

SEQ ID NO: 77850 - DNA, 15 bp, Homo sapiens
gacctggctcccttg

SEQ ID NO: 77851 - DNA, 15 bp, Homo sapiens
acctggctcccttgg

SEQ ID NO: 77852 - DNA, 15 bp, Homo sapiens
cctggctcccttggg

SEQ ID NO: 77853 - DNA, 15 bp, Homo sapiens
ctggctcccttgggc

SEQ ID NO: 77854 - DNA, 15 bp, Homo sapiens
tggctcccttgggca

SEQ ID NO: 77855 - DNA, 15 bp, Homo sapiens
ggctcccttgggcac

SEQ ID NO: 77856 - DNA, 15 bp, Homo sapiens
gctcccttgggcacc

SEQ ID NO: 77857 - DNA, 15 bp, Homo sapiens
ctcccttgggcacct

SEQ ID NO: 77858 - DNA, 15 bp, Homo sapiens
tcccttgggcacctg

SEQ ID NO: 77859 - DNA, 15 bp, Homo sapiens
cccttgggcacctga

SEQ ID NO: 77860 - DNA, 15 bp, Homo sapiens
ccttgggcacctgag

SEQ ID NO: 77861 - DNA, 15 bp, Homo sapiens
cttgggcacctgagg

SEQ ID NO: 77862 - DNA, 15 bp, Homo sapiens
ttgggcacctgaggc

SEQ ID NO: 77863 - DNA, 15 bp, Homo sapiens
tgggcacctgaggcc

SEQ ID NO: 77864 - DNA, 15 bp, Homo sapiens
gggcacctgaggcct

SEQ ID NO: 77865 - DNA, 15 bp, Homo sapiens
ggcacctgaggcctg

SEQ ID NO: 77866 - DNA, 15 bp, Homo sapiens
gcacctgaggcctgg

SEQ ID NO: 77867 - DNA, 15 bp, Homo sapiens
cacctgaggcctggc

SEQ ID NO: 77868 - DNA, 15 bp, Homo sapiens
acctgaggcctggca

SEQ ID NO: 77869 - DNA, 15 bp, Homo sapiens
cctgaggcctggcag

SEQ ID NO: 77870 - DNA, 15 bp, Homo sapiens
ctgaggcctggcagg

SEQ ID NO: 77871 - DNA, 15 bp, Homo sapiens
tgaggcctggcaggc

SEQ ID NO: 77872 - DNA, 15 bp, Homo sapiens
gaggcctggcaggcc

SEQ ID NO: 77873 - DNA, 15 bp, Homo sapiens
aggcctggcaggccc

SEQ ID NO: 77874 - DNA, 15 bp, Homo sapiens
ggcctggcaggcccg

SEQ ID NO: 77875 - DNA, 15 bp, Homo sapiens
gcctggcaggcccgg

SEQ ID NO: 77876 - DNA, 15 bp, Homo sapiens
cctggcaggcccggg

SEQ ID NO: 77877 - DNA, 15 bp, Homo sapiens
ctggcaggcccgggc

SEQ ID NO: 77878 - DNA, 15 bp, Homo sapiens
tggcaggcccgggcg

SEQ ID NO: 77879 - DNA, 15 bp, Homo sapiens
ggcaggcccgggcga

SEQ ID NO: 77880 - DNA, 15 bp, Homo sapiens
gcaggcccgggcgag

SEQ ID NO: 77881 - DNA, 15 bp, Homo sapiens
caggcccgggcgagc

SEQ ID NO: 77882 - DNA, 15 bp, Homo sapiens
aggcccgggcgagct

SEQ ID NO: 77883 - DNA, 15 bp, Homo sapiens
ggcccgggcgagctg

SEQ ID NO: 77884 - DNA, 15 bp, Homo sapiens
gcccgggcgagctga

SEQ ID NO: 77885 - DNA, 15 bp, Homo sapiens
cccgggcgagctgag

SEQ ID NO: 77886 - DNA, 15 bp, Homo sapiens
ccgggcgagctgagg

SEQ ID NO: 77887 - DNA, 15 bp, Homo sapiens
cgggcgagctgaggc

SEQ ID NO: 77888 - DNA, 15 bp, Homo sapiens
gggcgagctgaggcc

SEQ ID NO: 77889 - DNA, 15 bp, Homo sapiens
ggcgagctgaggccc

SEQ ID NO: 77890 - DNA, 15 bp, Homo sapiens
gcgagctgaggcccc

SEQ ID NO: 77891 - DNA, 15 bp, Homo sapiens
cgagctgaggcccca

SEQ ID NO: 77892 - DNA, 15 bp, Homo sapiens
gagctgaggccccag

SEQ ID NO: 77893 - DNA, 15 bp, Homo sapiens
agctgaggccccagc

SEQ ID NO: 77894 - DNA, 15 bp, Homo sapiens
gctgaggccccagcc

SEQ ID NO: 77895 - DNA, 15 bp, Homo sapiens
ctgaggccccagcca

SEQ ID NO: 77896 - DNA, 15 bp, Homo sapiens
tgaggccccagccag

SEQ ID NO: 77897 - DNA, 15 bp, Homo sapiens
gaggccccagccagg

SEQ ID NO: 77898 - DNA, 15 bp, Homo sapiens
aggccccagccaggg

SEQ ID NO: 77899 - DNA, 15 bp, Homo sapiens
ggccccagccagggc

SEQ ID NO: 77900 - DNA, 15 bp, Homo sapiens
gccccagccagggct

SEQ ID NO: 77901 - DNA, 15 bp, Homo sapiens
ccccagccagggctg

SEQ ID NO: 77902 - DNA, 15 bp, Homo sapiens
cccagccagggctgc

SEQ ID NO: 77903 - DNA, 15 bp, Homo sapiens
ccagccagggctgcc

SEQ ID NO: 77904 - DNA, 15 bp, Homo sapiens
cagccagggctgccc

SEQ ID NO: 77905 - DNA, 15 bp, Homo sapiens
agccagggctgccca

SEQ ID NO: 77906 - DNA, 15 bp, Homo sapiens
gccagggctgcccac

SEQ ID NO: 77907 - DNA, 15 bp, Homo sapiens
ccagggctgcccacc

SEQ ID NO: 77908 - DNA, 15 bp, Homo sapiens
cagggctgcccaccc

SEQ ID NO: 77909 - DNA, 15 bp, Homo sapiens
agggctgcccaccca

SEQ ID NO: 77910 - DNA, 15 bp, Homo sapiens
gggctgcccacccag

SEQ ID NO: 77911 - DNA, 15 bp, Homo sapiens
ggctgcccacccagt

SEQ ID NO: 77912 - DNA, 15 bp, Homo sapiens
gctgcccacccagtc

SEQ ID NO: 77913 - DNA, 15 bp, Homo sapiens
ctgcccacccagtct

SEQ ID NO: 77914 - DNA, 15 bp, Homo sapiens
tgcccacccagtctg

SEQ ID NO: 77915 - DNA, 15 bp, Homo sapiens
gcccacccagtctgg

SEQ ID NO: 77916 - DNA, 15 bp, Homo sapiens
cccacccagtctggc

SEQ ID NO: 77917 - DNA, 15 bp, Homo sapiens
ccacccagtctggcc

SEQ ID NO: 77918 - DNA, 15 bp, Homo sapiens
cacccagtctggcct

SEQ ID NO: 77919 - DNA, 15 bp, Homo sapiens
acccagtctggcctg

SEQ ID NO: 77920 - DNA, 15 bp, Homo sapiens
cccagtctggcctga

SEQ ID NO: 77921 - DNA, 15 bp, Homo sapiens
ccagtctggcctgat

SEQ ID NO: 77922 - DNA, 15 bp, Homo sapiens
cagtctggcctgatg

SEQ ID NO: 77923 - DNA, 15 bp, Homo sapiens
agtctggcctgatgg

SEQ ID NO: 77924 - DNA, 15 bp, Homo sapiens
gtctggcctgatgga

SEQ ID NO: 77925 - DNA, 15 bp, Homo sapiens
tctggcctgatggaa

SEQ ID NO: 77926 - DNA, 15 bp, Homo sapiens
ctggcctgatggaaa

SEQ ID NO: 77927 - DNA, 15 bp, Homo sapiens
tggcctgatggaaag

SEQ ID NO: 77928 - DNA, 15 bp, Homo sapiens
ggcctgatggaaagt

SEQ ID NO: 77929 - DNA, 15 bp, Homo sapiens
gcctgatggaaagtg

SEQ ID NO: 77930 - DNA, 15 bp, Homo sapiens
cctgatggaaagtgc

SEQ ID NO: 77931 - DNA, 15 bp, Homo sapiens
ctgatggaaagtgct

SEQ ID NO: 77932 - DNA, 15 bp, Homo sapiens
tgatggaaagtgctc

SEQ ID NO: 77933 - DNA, 15 bp, Homo sapiens
gatggaaagtgctcc

SEQ ID NO: 77934 - DNA, 15 bp, Homo sapiens
atggaaagtgctccc

SEQ ID NO: 77935 - DNA, 15 bp, Homo sapiens
tggaaagtgctcccc

SEQ ID NO: 77936 - DNA, 15 bp, Homo sapiens
ggaaagtgctcccct

SEQ ID NO: 77937 - DNA, 15 bp, Homo sapiens
gaaagtgctcccctt

SEQ ID NO: 77938 - DNA, 15 bp, Homo sapiens
aaagtgctccccttt

SEQ ID NO: 77939 - DNA, 15 bp, Homo sapiens
aagtgctcccctttt

SEQ ID NO: 77940 - DNA, 15 bp, Homo sapiens
agtgctccccttttt

SEQ ID NO: 77941 - DNA, 15 bp, Homo sapiens
gtgctcccctttttc

SEQ ID NO: 77942 - DNA, 15 bp, Homo sapiens
tgctcccctttttca

SEQ ID NO: 77943 - DNA, 15 bp, Homo sapiens
gctcccctttttcaa

SEQ ID NO: 77944 - DNA, 15 bp, Homo sapiens
ctcccctttttcaaa

SEQ ID NO: 77945 - DNA, 15 bp, Homo sapiens
tcccctttttcaaac

SEQ ID NO: 77946 - DNA, 15 bp, Homo sapiens
cccctttttcaaaca

SEQ ID NO: 77947 - DNA, 15 bp, Homo sapiens
ccctttttcaaacag

SEQ ID NO: 77948 - DNA, 15 bp, Homo sapiens
cctttttcaaacagg

SEQ ID NO: 77949 - DNA, 15 bp, Homo sapiens
ctttttcaaacaggt

SEQ ID NO: 77950 - DNA, 15 bp, Homo sapiens
tttttcaaacaggtt

SEQ ID NO: 77951 - DNA, 15 bp, Homo sapiens
ttttcaaacaggttt

SEQ ID NO: 77952 - DNA, 15 bp, Homo sapiens
tttcaaacaggtttc

SEQ ID NO: 77953 - DNA, 15 bp, Homo sapiens
ttcaaacaggtttcg

SEQ ID NO: 77954 - DNA, 15 bp, Homo sapiens
tcaaacaggtttcgt

SEQ ID NO: 77955 - DNA, 15 bp, Homo sapiens
caaacaggtttcgtc

SEQ ID NO: 77956 - DNA, 15 bp, Homo sapiens
aaacaggtttcgtca

SEQ ID NO: 77957 - DNA, 15 bp, Homo sapiens
aacaggtttcgtcac

SEQ ID NO: 77958 - DNA, 15 bp, Homo sapiens
acaggtttcgtcacc

SEQ ID NO: 77959 - DNA, 15 bp, Homo sapiens
caggtttcgtcaccc

SEQ ID NO: 77960 - DNA, 15 bp, Homo sapiens
aggtttcgtcaccca

SEQ ID NO: 77961 - DNA, 15 bp, Homo sapiens
ggtttcgtcacccaa

SEQ ID NO: 77962 - DNA, 15 bp, Homo sapiens
gtttcgtcacccaaa

SEQ ID NO: 77963 - DNA, 15 bp, Homo sapiens
tttcgtcacccaaac

SEQ ID NO: 77964 - DNA, 15 bp, Homo sapiens
ttcgtcacccaaaca

SEQ ID NO: 77965 - DNA, 15 bp, Homo sapiens
tcgtcacccaaacat

SEQ ID NO: 77966 - DNA, 15 bp, Homo sapiens
cgtcacccaaacatt

SEQ ID NO: 77967 - DNA, 15 bp, Homo sapiens
gtcacccaaacattg

SEQ ID NO: 77968 - DNA, 15 bp, Homo sapiens
tcacccaaacattgt

SEQ ID NO: 77969 - DNA, 15 bp, Homo sapiens
cacccaaacattgtg

SEQ ID NO: 77970 - DNA, 15 bp, Homo sapiens
acccaaacattgtgg

SEQ ID NO: 77971 - DNA, 15 bp, Homo sapiens
cccaaacattgtgga

SEQ ID NO: 77972 - DNA, 15 bp, Homo sapiens
ccaaacattgtggac

SEQ ID NO: 77973 - DNA, 15 bp, Homo sapiens
caaacattgtggact

SEQ ID NO: 77974 - DNA, 15 bp, Homo sapiens
aaacattgtggactt

SEQ ID NO: 77975 - DNA, 15 bp, Homo sapiens
aacattgtggacttt

SEQ ID NO: 77976 - DNA, 15 bp, Homo sapiens
acattgtggactttg

SEQ ID NO: 77977 - DNA, 15 bp, Homo sapiens
cattgtggactttgc

SEQ ID NO: 77978 - DNA, 15 bp, Homo sapiens
attgtggactttgct

SEQ ID NO: 77979 - DNA, 15 bp, Homo sapiens
ttgtggactttgctg

SEQ ID NO: 77980 - DNA, 15 bp, Homo sapiens
tgtggactttgctgg

SEQ ID NO: 77981 - DNA, 15 bp, Homo sapiens
gtggactttgctggc

SEQ ID NO: 77982 - DNA, 15 bp, Homo sapiens
tggactttgctggct

SEQ ID NO: 77983 - DNA, 15 bp, Homo sapiens
ggactttgctggcta

SEQ ID NO: 77984 - DNA, 15 bp, Homo sapiens
gactttgctggctac

SEQ ID NO: 77985 - DNA, 15 bp, Homo sapiens
actttgctggctact

SEQ ID NO: 77986 - DNA, 15 bp, Homo sapiens
ctttgctggctactg

SEQ ID NO: 77987 - DNA, 15 bp, Homo sapiens
tttgctggctactgt

SEQ ID NO: 77988 - DNA, 15 bp, Homo sapiens
ttgctggctactgtg

SEQ ID NO: 77989 - DNA, 15 bp, Homo sapiens
tgctggctactgtgc

SEQ ID NO: 77990 - DNA, 15 bp, Homo sapiens
gctggctactgtgct

SEQ ID NO: 77991 - DNA, 15 bp, Homo sapiens
ctggctactgtgctc

SEQ ID NO: 77992 - DNA, 15 bp, Homo sapiens
tggctactgtgctca

SEQ ID NO: 77993 - DNA, 15 bp, Homo sapiens
ggctactgtgctcag

SEQ ID NO: 77994 - DNA, 15 bp, Homo sapiens
gctactgtgctcaga

SEQ ID NO: 77995 - DNA, 15 bp, Homo sapiens
ctactgtgctcagaa

SEQ ID NO: 77996 - DNA, 15 bp, Homo sapiens
tactgtgctcagaac

SEQ ID NO: 77997 - DNA, 15 bp, Homo sapiens
actgtgctcagaacg

SEQ ID NO: 77998 - DNA, 15 bp, Homo sapiens
ctgtgctcagaacgg

SEQ ID NO: 77999 - DNA, 15 bp, Homo sapiens
tgtgctcagaacggc

SEQ ID NO: 78000 - DNA, 15 bp, Homo sapiens
gtgctcagaacggct

SEQ ID NO: 78001 - DNA, 15 bp, Homo sapiens
tgctcagaacggctt

SEQ ID NO: 78002 - DNA, 15 bp, Homo sapiens
gctcagaacggcttc

SEQ ID NO: 78003 - DNA, 15 bp, Homo sapiens
ctcagaacggcttct

SEQ ID NO: 78004 - DNA, 15 bp, Homo sapiens
tcagaacggcttcta

SEQ ID NO: 78005 - DNA, 15 bp, Homo sapiens
cagaacggcttctac

SEQ ID NO: 78006 - DNA, 15 bp, Homo sapiens
agaacggcttctact

SEQ ID NO: 78007 - DNA, 15 bp, Homo sapiens
gaacggcttctactg

SEQ ID NO: 78008 - DNA, 15 bp, Homo sapiens
aacggcttctactgc

SEQ ID NO: 78009 - DNA, 15 bp, Homo sapiens
acggcttctactgcc

SEQ ID NO: 78010 - DNA, 15 bp, Homo sapiens
cggcttctactgcct

SEQ ID NO: 78011 - DNA, 15 bp, Homo sapiens
ggcttctactgcctg

SEQ ID NO: 78012 - DNA, 15 bp, Homo sapiens
gcttctactgcctgg

SEQ ID NO: 78013 - DNA, 15 bp, Homo sapiens
cttctactgcctggt

SEQ ID NO: 78014 - DNA, 15 bp, Homo sapiens
ttctactgcctggtg

SEQ ID NO: 78015 - DNA, 15 bp, Homo sapiens
tctactgcctggtgt

SEQ ID NO: 78016 - DNA, 15 bp, Homo sapiens
ctactgcctggtgta

SEQ ID NO: 78017 - DNA, 15 bp, Homo sapiens
tactgcctggtgtac

SEQ ID NO: 78018 - DNA, 15 bp, Homo sapiens
actgcctggtgtacg

SEQ ID NO: 78019 - DNA, 15 bp, Homo sapiens
ctgcctggtgtacgg

SEQ ID NO: 78020 - DNA, 15 bp, Homo sapiens
tgcctggtgtacggc

SEQ ID NO: 78021 - DNA, 15 bp, Homo sapiens
gcctggtgtacggct

SEQ ID NO: 78022 - DNA, 15 bp, Homo sapiens
cctggtgtacggctt

SEQ ID NO: 78023 - DNA, 15 bp, Homo sapiens
ctggtgtacggcttc

SEQ ID NO: 78024 - DNA, 15 bp, Homo sapiens
tggtgtacggcttcc

SEQ ID NO: 78025 - DNA, 15 bp, Homo sapiens
ggtgtacggcttcct

SEQ ID NO: 78026 - DNA, 15 bp, Homo sapiens
gtgtacggcttcctg

SEQ ID NO: 78027 - DNA, 15 bp, Homo sapiens
tgtacggcttcctgc

SEQ ID NO: 78028 - DNA, 15 bp, Homo sapiens
gtacggcttcctgcc

SEQ ID NO: 78029 - DNA, 15 bp, Homo sapiens
tacggcttcctgccc

SEQ ID NO: 78030 - DNA, 15 bp, Homo sapiens
acggcttcctgccca

SEQ ID NO: 78031 - DNA, 15 bp, Homo sapiens
cggcttcctgcccaa

SEQ ID NO: 78032 - DNA, 15 bp, Homo sapiens
ggcttcctgcccaac

SEQ ID NO: 78033 - DNA, 15 bp, Homo sapiens
gcttcctgcccaacg

SEQ ID NO: 78034 - DNA, 15 bp, Homo sapiens
cttcctgcccaacgg

SEQ ID NO: 78035 - DNA, 15 bp, Homo sapiens
ttcctgcccaacggc

SEQ ID NO: 78036 - DNA, 15 bp, Homo sapiens
tcctgcccaacggct

SEQ ID NO: 78037 - DNA, 15 bp, Homo sapiens
cctgcccaacggctc

SEQ ID NO: 78038 - DNA, 15 bp, Homo sapiens
ctgcccaacggctcc

SEQ ID NO: 78039 - DNA, 15 bp, Homo sapiens
tgcccaacggctccc

SEQ ID NO: 78040 - DNA, 15 bp, Homo sapiens
gcccaacggctccct

SEQ ID NO: 78041 - DNA, 15 bp, Homo sapiens
cccaacggctccctg

SEQ ID NO: 78042 - DNA, 15 bp, Homo sapiens
ccaacggctccctgg

SEQ ID NO: 78043 - DNA, 15 bp, Homo sapiens
caacggctccctgga

SEQ ID NO: 78044 - DNA, 15 bp, Homo sapiens
aacggctccctggag

SEQ ID NO: 78045 - DNA, 15 bp, Homo sapiens
acggctccctggagg

SEQ ID NO: 78046 - DNA, 15 bp, Homo sapiens
cggctccctggagga

SEQ ID NO: 78047 - DNA, 15 bp, Homo sapiens
ggctccctggaggac

SEQ ID NO: 78048 - DNA, 15 bp, Homo sapiens
gctccctggaggacc

SEQ ID NO: 78049 - DNA, 15 bp, Homo sapiens
ctccctggaggaccg

SEQ ID NO: 78050 - DNA, 15 bp, Homo sapiens
tccctggaggaccgt

SEQ ID NO: 78051 - DNA, 15 bp, Homo sapiens
ccctggaggaccgtc

SEQ ID NO: 78052 - DNA, 15 bp, Homo sapiens
cctggaggaccgtct

SEQ ID NO: 78053 - DNA, 15 bp, Homo sapiens
ctggaggaccgtctc

SEQ ID NO: 78054 - DNA, 15 bp, Homo sapiens
tggaggaccgtctcc

SEQ ID NO: 78055 - DNA, 15 bp, Homo sapiens
ggaggaccgtctcca

SEQ ID NO: 78056 - DNA, 15 bp, Homo sapiens
gaggaccgtctccac

SEQ ID NO: 78057 - DNA, 15 bp, Homo sapiens
aggaccgtctccact

SEQ ID NO: 78058 - DNA, 15 bp, Homo sapiens
ggaccgtctccactg

SEQ ID NO: 78059 - DNA, 15 bp, Homo sapiens
gaccgtctccactgc

SEQ ID NO: 78060 - DNA, 15 bp, Homo sapiens
accgtctccactgcc

SEQ ID NO: 78061 - DNA, 15 bp, Homo sapiens
ccgtctccactgcca

SEQ ID NO: 78062 - DNA, 15 bp, Homo sapiens
cgtctccactgccag

SEQ ID NO: 78063 - DNA, 15 bp, Homo sapiens
gtctccactgccagg

SEQ ID NO: 78064 - DNA, 15 bp, Homo sapiens
tctccactgccaggt

SEQ ID NO: 78065 - DNA, 15 bp, Homo sapiens
ctccactgccaggta

SEQ ID NO: 78066 - DNA, 15 bp, Homo sapiens
tccactgccaggtag

SEQ ID NO: 78067 - DNA, 15 bp, Homo sapiens
ccactgccaggtagg

SEQ ID NO: 78068 - DNA, 15 bp, Homo sapiens
cactgccaggtaggc

SEQ ID NO: 78069 - DNA, 15 bp, Homo sapiens
actgccaggtaggct

SEQ ID NO: 78070 - DNA, 15 bp, Homo sapiens
ctgccaggtaggctc

SEQ ID NO: 78071 - DNA, 15 bp, Homo sapiens
tgccaggtaggctca

SEQ ID NO: 78072 - DNA, 15 bp, Homo sapiens
gccaggtaggctcac

SEQ ID NO: 78073 - DNA, 15 bp, Homo sapiens
ccaggtaggctcacc

SEQ ID NO: 78074 - DNA, 15 bp, Homo sapiens
caggtaggctcacct

SEQ ID NO: 78075 - DNA, 15 bp, Homo sapiens
aggtaggctcacctg

SEQ ID NO: 78076 - DNA, 15 bp, Homo sapiens
ggtaggctcacctgg

SEQ ID NO: 78077 - DNA, 15 bp, Homo sapiens
gtaggctcacctggc

SEQ ID NO: 78078 - DNA, 15 bp, Homo sapiens
taggctcacctggcc

SEQ ID NO: 78079 - DNA, 15 bp, Homo sapiens
aggctcacctggccc

SEQ ID NO: 78080 - DNA, 15 bp, Homo sapiens
ggctcacctggcccg

SEQ ID NO: 78081 - DNA, 15 bp, Homo sapiens
gctcacctggcccgg

SEQ ID NO: 78082 - DNA, 15 bp, Homo sapiens
ctcacctggcccggc

SEQ ID NO: 78083 - DNA, 15 bp, Homo sapiens
tcacctggcccggca

SEQ ID NO: 78084 - DNA, 15 bp, Homo sapiens
cacctggcccggcac

SEQ ID NO: 78085 - DNA, 15 bp, Homo sapiens
acctggcccggcacg

SEQ ID NO: 78086 - DNA, 15 bp, Homo sapiens
cctggcccggcacgc

SEQ ID NO: 78087 - DNA, 15 bp, Homo sapiens
ctggcccggcacgct

SEQ ID NO: 78088 - DNA, 15 bp, Homo sapiens
tggcccggcacgctt

SEQ ID NO: 78089 - DNA, 15 bp, Homo sapiens
ggcccggcacgcttc

SEQ ID NO: 78090 - DNA, 15 bp, Homo sapiens
gcccggcacgcttcc

SEQ ID NO: 78091 - DNA, 15 bp, Homo sapiens
cccggcacgcttccc

SEQ ID NO: 78092 - DNA, 15 bp, Homo sapiens
ccggcacgcttccca

SEQ ID NO: 78093 - DNA, 15 bp, Homo sapiens
cggcacgcttcccag

SEQ ID NO: 78094 - DNA, 15 bp, Homo sapiens
ggcacgcttcccagg

SEQ ID NO: 78095 - DNA, 15 bp, Homo sapiens
gcacgcttcccagga

SEQ ID NO: 78096 - DNA, 15 bp, Homo sapiens
cacgcttcccaggac

SEQ ID NO: 78097 - DNA, 15 bp, Homo sapiens
acgcttcccaggacc

SEQ ID NO: 78098 - DNA, 15 bp, Homo sapiens
cgcttcccaggaccc

SEQ ID NO: 78099 - DNA, 15 bp, Homo sapiens
gcttcccaggaccca

SEQ ID NO: 78100 - DNA, 15 bp, Homo sapiens
cttcccaggacccaa

SEQ ID NO: 78101 - DNA, 15 bp, Homo sapiens
ttcccaggacccaaa

SEQ ID NO: 78102 - DNA, 15 bp, Homo sapiens
tcccaggacccaaag

SEQ ID NO: 78103 - DNA, 15 bp, Homo sapiens
cccaggacccaaagc

SEQ ID NO: 78104 - DNA, 15 bp, Homo sapiens
ccaggacccaaagca

SEQ ID NO: 78105 - DNA, 15 bp, Homo sapiens
caggacccaaagcac

SEQ ID NO: 78106 - DNA, 15 bp, Homo sapiens
aggacccaaagcact

SEQ ID NO: 78107 - DNA, 15 bp, Homo sapiens
ggacccaaagcactc

SEQ ID NO: 78108 - DNA, 15 bp, Homo sapiens
gacccaaagcactcc

SEQ ID NO: 78109 - DNA, 15 bp, Homo sapiens
acccaaagcactcct

SEQ ID NO: 78110 - DNA, 15 bp, Homo sapiens
cccaaagcactcctg

SEQ ID NO: 78111 - DNA, 15 bp, Homo sapiens
ccaaagcactcctga

SEQ ID NO: 78112 - DNA, 15 bp, Homo sapiens
caaagcactcctgac

SEQ ID NO: 78113 - DNA, 15 bp, Homo sapiens
aaagcactcctgaca

SEQ ID NO: 78114 - DNA, 15 bp, Homo sapiens
aagcactcctgacac

SEQ ID NO: 78115 - DNA, 15 bp, Homo sapiens
agcactcctgacacc

SEQ ID NO: 78116 - DNA, 15 bp, Homo sapiens
gcactcctgacacct

SEQ ID NO: 78117 - DNA, 15 bp, Homo sapiens
cactcctgacacctg

SEQ ID NO: 78118 - DNA, 15 bp, Homo sapiens
actcctgacacctgg

SEQ ID NO: 78119 - DNA, 15 bp, Homo sapiens
ctcctgacacctggc

SEQ ID NO: 78120 - DNA, 15 bp, Homo sapiens
tcctgacacctggct

SEQ ID NO: 78121 - DNA, 15 bp, Homo sapiens
cctgacacctggctg

SEQ ID NO: 78122 - DNA, 15 bp, Homo sapiens
ctgacacctggctgg

SEQ ID NO: 78123 - DNA, 15 bp, Homo sapiens
tgacacctggctgga

SEQ ID NO: 78124 - DNA, 15 bp, Homo sapiens
gacacctggctggag

SEQ ID NO: 78125 - DNA, 15 bp, Homo sapiens
acacctggctggagc

SEQ ID NO: 78126 - DNA, 15 bp, Homo sapiens
cacctggctggagcc

SEQ ID NO: 78127 - DNA, 15 bp, Homo sapiens
acctggctggagccg

SEQ ID NO: 78128 - DNA, 15 bp, Homo sapiens
cctggctggagccgg

SEQ ID NO: 78129 - DNA, 15 bp, Homo sapiens
ctggctggagccggg

SEQ ID NO: 78130 - DNA, 15 bp, Homo sapiens
tggctggagccgggc

SEQ ID NO: 78131 - DNA, 15 bp, Homo sapiens
ggctggagccgggcg

SEQ ID NO: 78132 - DNA, 15 bp, Homo sapiens
gctggagccgggcgc

SEQ ID NO: 78133 - DNA, 15 bp, Homo sapiens
ctggagccgggcgcg

SEQ ID NO: 78134 - DNA, 15 bp, Homo sapiens
tggagccgggcgcgg

SEQ ID NO: 78135 - DNA, 15 bp, Homo sapiens
ggagccgggcgcggg

SEQ ID NO: 78136 - DNA, 15 bp, Homo sapiens
gagccgggcgcgggg

SEQ ID NO: 78137 - DNA, 15 bp, Homo sapiens
agccgggcgcggggc

SEQ ID NO: 78138 - DNA, 15 bp, Homo sapiens
gccgggcgcggggcc

SEQ ID NO: 78139 - DNA, 15 bp, Homo sapiens
ccgggcgcggggcct

SEQ ID NO: 78140 - DNA, 15 bp, Homo sapiens
cgggcgcggggccta

SEQ ID NO: 78141 - DNA, 15 bp, Homo sapiens
gggcgcggggcctag

SEQ ID NO: 78142 - DNA, 15 bp, Homo sapiens
ggcgcggggcctagg

SEQ ID NO: 78143 - DNA, 15 bp, Homo sapiens
gcgcggggcctaggg

SEQ ID NO: 78144 - DNA, 15 bp, Homo sapiens
cgcggggcctagggc

SEQ ID NO: 78145 - DNA, 15 bp, Homo sapiens
gcggggcctagggct

SEQ ID NO: 78146 - DNA, 15 bp, Homo sapiens
cggggcctagggctt

SEQ ID NO: 78147 - DNA, 15 bp, Homo sapiens
ggggcctagggcttt

SEQ ID NO: 78148 - DNA, 15 bp, Homo sapiens
gggcctagggctttc

SEQ ID NO: 78149 - DNA, 15 bp, Homo sapiens
ggcctagggctttca

SEQ ID NO: 78150 - DNA, 15 bp, Homo sapiens
gcctagggctttcag

SEQ ID NO: 78151 - DNA, 15 bp, Homo sapiens
cctagggctttcagc

SEQ ID NO: 78152 - DNA, 15 bp, Homo sapiens
ctagggctttcagcc

SEQ ID NO: 78153 - DNA, 15 bp, Homo sapiens
tagggctttcagcct

SEQ ID NO: 78154 - DNA, 15 bp, Homo sapiens
agggctttcagcctg

SEQ ID NO: 78155 - DNA, 15 bp, Homo sapiens
gggctttcagcctgt

SEQ ID NO: 78156 - DNA, 15 bp, Homo sapiens
ggctttcagcctgtg

SEQ ID NO: 78157 - DNA, 15 bp, Homo sapiens
gctttcagcctgtgt

SEQ ID NO: 78158 - DNA, 15 bp, Homo sapiens
ctttcagcctgtgtg

SEQ ID NO: 78159 - DNA, 15 bp, Homo sapiens
tttcagcctgtgtga

SEQ ID NO: 78160 - DNA, 15 bp, Homo sapiens
ttcagcctgtgtgag

SEQ ID NO: 78161 - DNA, 15 bp, Homo sapiens
tcagcctgtgtgagt

SEQ ID NO: 78162 - DNA, 15 bp, Homo sapiens
cagcctgtgtgagtg

SEQ ID NO: 78163 - DNA, 15 bp, Homo sapiens
agcctgtgtgagtgg

SEQ ID NO: 78164 - DNA, 15 bp, Homo sapiens
gcctgtgtgagtggg

SEQ ID NO: 78165 - DNA, 15 bp, Homo sapiens
cctgtgtgagtgggt

SEQ ID NO: 78166 - DNA, 15 bp, Homo sapiens
ctgtgtgagtgggtc

SEQ ID NO: 78167 - DNA, 15 bp, Homo sapiens
tgtgtgagtgggtcc

SEQ ID NO: 78168 - DNA, 15 bp, Homo sapiens
gtgtgagtgggtcct

SEQ ID NO: 78169 - DNA, 15 bp, Homo sapiens
tgtgagtgggtcctg

SEQ ID NO: 78170 - DNA, 15 bp, Homo sapiens
gtgagtgggtcctgc

SEQ ID NO: 78171 - DNA, 15 bp, Homo sapiens
tgagtgggtcctgcc

SEQ ID NO: 78172 - DNA, 15 bp, Homo sapiens
gagtgggtcctgcca

SEQ ID NO: 78173 - DNA, 15 bp, Homo sapiens
agtgggtcctgccag

SEQ ID NO: 78174 - DNA, 15 bp, Homo sapiens
gtgggtcctgccagc

SEQ ID NO: 78175 - DNA, 15 bp, Homo sapiens
tgggtcctgccagca

SEQ ID NO: 78176 - DNA, 15 bp, Homo sapiens
gggtcctgccagcag

SEQ ID NO: 78177 - DNA, 15 bp, Homo sapiens
ggtcctgccagcagg

SEQ ID NO: 78178 - DNA, 15 bp, Homo sapiens
gtcctgccagcaggc

SEQ ID NO: 78179 - DNA, 15 bp, Homo sapiens
tcctgccagcaggcc

SEQ ID NO: 78180 - DNA, 15 bp, Homo sapiens
cctgccagcaggcca

SEQ ID NO: 78181 - DNA, 15 bp, Homo sapiens
ctgccagcaggccag

SEQ ID NO: 78182 - DNA, 15 bp, Homo sapiens
tgccagcaggccagg

SEQ ID NO: 78183 - DNA, 15 bp, Homo sapiens
gccagcaggccaggc

SEQ ID NO: 78184 - DNA, 15 bp, Homo sapiens
ccagcaggccaggcc

SEQ ID NO: 78185 - DNA, 15 bp, Homo sapiens
cagcaggccaggcct

SEQ ID NO: 78186 - DNA, 15 bp, Homo sapiens
agcaggccaggcctg

SEQ ID NO: 78187 - DNA, 15 bp, Homo sapiens
gcaggccaggcctgc

SEQ ID NO: 78188 - DNA, 15 bp, Homo sapiens
caggccaggcctgca

SEQ ID NO: 78189 - DNA, 15 bp, Homo sapiens
aggccaggcctgcac

SEQ ID NO: 78190 - DNA, 15 bp, Homo sapiens
ggccaggcctgcact

SEQ ID NO: 78191 - DNA, 15 bp, Homo sapiens
gccaggcctgcactt

SEQ ID NO: 78192 - DNA, 15 bp, Homo sapiens
ccaggcctgcacttc

SEQ ID NO: 78193 - DNA, 15 bp, Homo sapiens
caggcctgcacttcc

SEQ ID NO: 78194 - DNA, 15 bp, Homo sapiens
aggcctgcacttcca

SEQ ID NO: 78195 - DNA, 15 bp, Homo sapiens
ggcctgcacttccag

SEQ ID NO: 78196 - DNA, 15 bp, Homo sapiens
gcctgcacttccagc

SEQ ID NO: 78197 - DNA, 15 bp, Homo sapiens
cctgcacttccagct

SEQ ID NO: 78198 - DNA, 15 bp, Homo sapiens
ctgcacttccagctc

SEQ ID NO: 78199 - DNA, 15 bp, Homo sapiens
tgcacttccagctcc

SEQ ID NO: 78200 - DNA, 15 bp, Homo sapiens
gcacttccagctccc

SEQ ID NO: 78201 - DNA, 15 bp, Homo sapiens
cacttccagctcccc

SEQ ID NO: 78202 - DNA, 15 bp, Homo sapiens
acttccagctcccca

SEQ ID NO: 78203 - DNA, 15 bp, Homo sapiens
cttccagctccccag

SEQ ID NO: 78204 - DNA, 15 bp, Homo sapiens
ttccagctccccagc

SEQ ID NO: 78205 - DNA, 15 bp, Homo sapiens
tccagctccccagca

SEQ ID NO: 78206 - DNA, 15 bp, Homo sapiens
ccagctccccagcag

SEQ ID NO: 78207 - DNA, 15 bp, Homo sapiens
cagctccccagcagc

SEQ ID NO: 78208 - DNA, 15 bp, Homo sapiens
agctccccagcagca

SEQ ID NO: 78209 - DNA, 15 bp, Homo sapiens
gctccccagcagcac

SEQ ID NO: 78210 - DNA, 15 bp, Homo sapiens
ctccccagcagcacc

SEQ ID NO: 78211 - DNA, 15 bp, Homo sapiens
tccccagcagcaccc

SEQ ID NO: 78212 - DNA, 15 bp, Homo sapiens
ccccagcagcacccg

SEQ ID NO: 78213 - DNA, 15 bp, Homo sapiens
cccagcagcacccgg

SEQ ID NO: 78214 - DNA, 15 bp, Homo sapiens
ccagcagcacccggc

SEQ ID NO: 78215 - DNA, 15 bp, Homo sapiens
cagcagcacccggct

SEQ ID NO: 78216 - DNA, 15 bp, Homo sapiens
agcagcacccggctc

SEQ ID NO: 78217 - DNA, 15 bp, Homo sapiens
gcagcacccggctca

SEQ ID NO: 78218 - DNA, 15 bp, Homo sapiens
cagcacccggctcag

SEQ ID NO: 78219 - DNA, 15 bp, Homo sapiens
agcacccggctcagg

SEQ ID NO: 78220 - DNA, 15 bp, Homo sapiens
gcacccggctcagga

SEQ ID NO: 78221 - DNA, 15 bp, Homo sapiens
cacccggctcaggat

SEQ ID NO: 78222 - DNA, 15 bp, Homo sapiens
acccggctcaggatt

SEQ ID NO: 78223 - DNA, 15 bp, Homo sapiens
cccggctcaggattt

SEQ ID NO: 78224 - DNA, 15 bp, Homo sapiens
ccggctcaggatttg

SEQ ID NO: 78225 - DNA, 15 bp, Homo sapiens
cggctcaggatttgg

SEQ ID NO: 78226 - DNA, 15 bp, Homo sapiens
ggctcaggatttggc

SEQ ID NO: 78227 - DNA, 15 bp, Homo sapiens
gctcaggatttggcc

SEQ ID NO: 78228 - DNA, 15 bp, Homo sapiens
ctcaggatttggccc

SEQ ID NO: 78229 - DNA, 15 bp, Homo sapiens
tcaggatttggccca

SEQ ID NO: 78230 - DNA, 15 bp, Homo sapiens
caggatttggcccac

SEQ ID NO: 78231 - DNA, 15 bp, Homo sapiens
aggatttggcccacg

SEQ ID NO: 78232 - DNA, 15 bp, Homo sapiens
ggatttggcccacgg

SEQ ID NO: 78233 - DNA, 15 bp, Homo sapiens
gatttggcccacggt

SEQ ID NO: 78234 - DNA, 15 bp, Homo sapiens
atttggcccacggtg

SEQ ID NO: 78235 - DNA, 15 bp, Homo sapiens
tttggcccacggtgg

SEQ ID NO: 78236 - DNA, 15 bp, Homo sapiens
ttggcccacggtggg

SEQ ID NO: 78237 - DNA, 15 bp, Homo sapiens
tggcccacggtgggg

SEQ ID NO: 78238 - DNA, 15 bp, Homo sapiens
ggcccacggtggggt

SEQ ID NO: 78239 - DNA, 15 bp, Homo sapiens
gcccacggtggggtc

SEQ ID NO: 78240 - DNA, 15 bp, Homo sapiens
cccacggtggggtca

SEQ ID NO: 78241 - DNA, 15 bp, Homo sapiens
ccacggtggggtcaa

SEQ ID NO: 78242 - DNA, 15 bp, Homo sapiens
cacggtggggtcaat

SEQ ID NO: 78243 - DNA, 15 bp, Homo sapiens
acggtggggtcaatt

SEQ ID NO: 78244 - DNA, 15 bp, Homo sapiens
cggtggggtcaattt

SEQ ID NO: 78245 - DNA, 15 bp, Homo sapiens
ggtggggtcaatttt

SEQ ID NO: 78246 - DNA, 15 bp, Homo sapiens
gtggggtcaattttt

SEQ ID NO: 78247 - DNA, 15 bp, Homo sapiens
tggggtcaatttttt

SEQ ID NO: 78248 - DNA, 15 bp, Homo sapiens
ggggtcaattttttt

SEQ ID NO: 78249 - DNA, 15 bp, Homo sapiens
gggtcaatttttttt

SEQ ID NO: 78250 - DNA, 15 bp, Homo sapiens
ggtcaattttttttt

SEQ ID NO: 78251 - DNA, 15 bp, Homo sapiens
gtcaatttttttttt

SEQ ID NO: 78252 - DNA, 15 bp, Homo sapiens
tcaattttttttttt

SEQ ID NO: 78253 - DNA, 15 bp, Homo sapiens
ttttttttttgaggt

SEQ ID NO: 78254 - DNA, 15 bp, Homo sapiens
tttttttttgaggtg

SEQ ID NO: 78255 - DNA, 15 bp, Homo sapiens
ttttttttgaggtgg

SEQ ID NO: 78256 - DNA, 15 bp, Homo sapiens
tttttttgaggtgga

SEQ ID NO: 78257 - DNA, 15 bp, Homo sapiens
ttttttgaggtggag

SEQ ID NO: 78258 - DNA, 15 bp, Homo sapiens
tttttgaggtggagt

SEQ ID NO: 78259 - DNA, 15 bp, Homo sapiens
ttttgaggtggagtc

SEQ ID NO: 78260 - DNA, 15 bp, Homo sapiens
tttgaggtggagtct

SEQ ID NO: 78261 - DNA, 15 bp, Homo sapiens
ttgaggtggagtctt

SEQ ID NO: 78262 - DNA, 15 bp, Homo sapiens
tgaggtggagtcttg

SEQ ID NO: 78263 - DNA, 15 bp, Homo sapiens
gaggtggagtcttgc

SEQ ID NO: 78264 - DNA, 15 bp, Homo sapiens
aggtggagtcttgct

SEQ ID NO: 78265 - DNA, 15 bp, Homo sapiens
ggtggagtcttgctc

SEQ ID NO: 78266 - DNA, 15 bp, Homo sapiens
gtggagtcttgctct

SEQ ID NO: 78267 - DNA, 15 bp, Homo sapiens
atctcagctcaccac

SEQ ID NO: 78268 - DNA, 15 bp, Homo sapiens
tctcagctcaccaca

SEQ ID NO: 78269 - DNA, 15 bp, Homo sapiens
ctcagctcaccacaa

SEQ ID NO: 78270 - DNA, 15 bp, Homo sapiens
tcagctcaccacaac

SEQ ID NO: 78271 - DNA, 15 bp, Homo sapiens
cagctcaccacaacc

SEQ ID NO: 78272 - DNA, 15 bp, Homo sapiens
agctcaccacaacct

SEQ ID NO: 78273 - DNA, 15 bp, Homo sapiens
gctcaccacaacctc

SEQ ID NO: 78274 - DNA, 15 bp, Homo sapiens
ctcaccacaacctcc

SEQ ID NO: 78275 - DNA, 15 bp, Homo sapiens
tcaccacaacctcca

SEQ ID NO: 78276 - DNA, 15 bp, Homo sapiens
caccacaacctccac

SEQ ID NO: 78277 - DNA, 15 bp, Homo sapiens
accacaacctccacc

SEQ ID NO: 78278 - DNA, 15 bp, Homo sapiens
ccacaacctccacct

SEQ ID NO: 78279 - DNA, 15 bp, Homo sapiens
cacaacctccacctc

SEQ ID NO: 78280 - DNA, 15 bp, Homo sapiens
acaacctccacctcc

SEQ ID NO: 78281 - DNA, 15 bp, Homo sapiens
aacctccacctcccg

SEQ ID NO: 78282 - DNA, 15 bp, Homo sapiens
acctccacctcccgg

SEQ ID NO: 78283 - DNA, 15 bp, Homo sapiens
cctccacctcccggg

SEQ ID NO: 78284 - DNA, 15 bp, Homo sapiens
ctccacctcccgggt

SEQ ID NO: 78285 - DNA, 15 bp, Homo sapiens
tccacctcccgggtt

SEQ ID NO: 78286 - DNA, 15 bp, Homo sapiens
ccacctcccgggttc

SEQ ID NO: 78287 - DNA, 15 bp, Homo sapiens
cacctcccgggttca

SEQ ID NO: 78288 - DNA, 15 bp, Homo sapiens
acctcccgggttcag

SEQ ID NO: 78289 - DNA, 15 bp, Homo sapiens
cctcccgggttcagg

SEQ ID NO: 78290 - DNA, 15 bp, Homo sapiens
ctcccgggttcaggc

SEQ ID NO: 78291 - DNA, 15 bp, Homo sapiens
tcccgggttcaggcg

SEQ ID NO: 78292 - DNA, 15 bp, Homo sapiens
cccgggttcaggcga

SEQ ID NO: 78293 - DNA, 15 bp, Homo sapiens
ccgggttcaggcgat

SEQ ID NO: 78294 - DNA, 15 bp, Homo sapiens
cgggttcaggcgatc

SEQ ID NO: 78295 - DNA, 15 bp, Homo sapiens
gggttcaggcgatcc

SEQ ID NO: 78296 - DNA, 15 bp, Homo sapiens
ggttcaggcgatcct

SEQ ID NO: 78297 - DNA, 15 bp, Homo sapiens
gttcaggcgatcctc

SEQ ID NO: 78298 - DNA, 15 bp, Homo sapiens
ttcaggcgatcctcc

SEQ ID NO: 78299 - DNA, 15 bp, Homo sapiens
tcaggcgatcctcct

SEQ ID NO: 78300 - DNA, 15 bp, Homo sapiens
caggcgatcctcctg

SEQ ID NO: 78301 - DNA, 15 bp, Homo sapiens
aggcgatcctcctgc

SEQ ID NO: 78302 - DNA, 15 bp, Homo sapiens
ggcgatcctcctgcc

SEQ ID NO: 78303 - DNA, 15 bp, Homo sapiens
gcgatcctcctgccg

SEQ ID NO: 78304 - DNA, 15 bp, Homo sapiens
cgatcctcctgccgc

SEQ ID NO: 78305 - DNA, 15 bp, Homo sapiens
gatcctcctgccgca

SEQ ID NO: 78306 - DNA, 15 bp, Homo sapiens
atcctcctgccgcag

SEQ ID NO: 78307 - DNA, 15 bp, Homo sapiens
tcctcctgccgcagc

SEQ ID NO: 78308 - DNA, 15 bp, Homo sapiens
cctcctgccgcagcc

SEQ ID NO: 78309 - DNA, 15 bp, Homo sapiens
ctgccgcagcctccc

SEQ ID NO: 78310 - DNA, 15 bp, Homo sapiens
tgccgcagcctcccg

SEQ ID NO: 78311 - DNA, 15 bp, Homo sapiens
gccgcagcctcccga

SEQ ID NO: 78312 - DNA, 15 bp, Homo sapiens
ccgcagcctcccgag

SEQ ID NO: 78313 - DNA, 15 bp, Homo sapiens
cgcagcctcccgagt

SEQ ID NO: 78314 - DNA, 15 bp, Homo sapiens
gcagcctcccgagta

SEQ ID NO: 78315 - DNA, 15 bp, Homo sapiens
ggactacaggcatgc

SEQ ID NO: 78316 - DNA, 15 bp, Homo sapiens
gactacaggcatgca

SEQ ID NO: 78317 - DNA, 15 bp, Homo sapiens
gcatgcaccaccaca

SEQ ID NO: 78318 - DNA, 15 bp, Homo sapiens
catgcaccaccacac

SEQ ID NO: 78319 - DNA, 15 bp, Homo sapiens
caccaccacacctgc

SEQ ID NO: 78320 - DNA, 15 bp, Homo sapiens
accaccacacctgcc

SEQ ID NO: 78321 - DNA, 15 bp, Homo sapiens
ccaccacacctgcct

SEQ ID NO: 78322 - DNA, 15 bp, Homo sapiens
caccacacctgccta

SEQ ID NO: 78323 - DNA, 15 bp, Homo sapiens
accacacctgcctaa

SEQ ID NO: 78324 - DNA, 15 bp, Homo sapiens
ccacacctgcctaat

SEQ ID NO: 78325 - DNA, 15 bp, Homo sapiens
cacacctgcctaatt

SEQ ID NO: 78326 - DNA, 15 bp, Homo sapiens
acacctgcctaattt

SEQ ID NO: 78327 - DNA, 15 bp, Homo sapiens
cacctgcctaatttt

SEQ ID NO: 78328 - DNA, 15 bp, Homo sapiens
acctgcctaattttt

SEQ ID NO: 78329 - DNA, 15 bp, Homo sapiens
cctgcctaatttttg

SEQ ID NO: 78330 - DNA, 15 bp, Homo sapiens
ctgcctaatttttgt

SEQ ID NO: 78331 - DNA, 15 bp, Homo sapiens
tgcctaatttttgta

SEQ ID NO: 78332 - DNA, 15 bp, Homo sapiens
gcctaatttttgtat

SEQ ID NO: 78333 - DNA, 15 bp, Homo sapiens
cctaatttttgtatt

SEQ ID NO: 78334 - DNA, 15 bp, Homo sapiens
ttttagtagagatga

SEQ ID NO: 78335 - DNA, 15 bp, Homo sapiens
tttagtagagatgag

SEQ ID NO: 78336 - DNA, 15 bp, Homo sapiens
ttagtagagatgagg

SEQ ID NO: 78337 - DNA, 15 bp, Homo sapiens
tagtagagatgaggt

SEQ ID NO: 78338 - DNA, 15 bp, Homo sapiens
agtagagatgaggtt

SEQ ID NO: 78339 - DNA, 15 bp, Homo sapiens
gtagagatgaggttt

SEQ ID NO: 78340 - DNA, 15 bp, Homo sapiens
tagagatgaggtttt

SEQ ID NO: 78341 - DNA, 15 bp, Homo sapiens
agagatgaggttttg

SEQ ID NO: 78342 - DNA, 15 bp, Homo sapiens
gagatgaggttttgc

SEQ ID NO: 78343 - DNA, 15 bp, Homo sapiens
agatgaggttttgcc

SEQ ID NO: 78344 - DNA, 15 bp, Homo sapiens
gatgaggttttgcca

SEQ ID NO: 78345 - DNA, 15 bp, Homo sapiens
atgaggttttgccac

SEQ ID NO: 78346 - DNA, 15 bp, Homo sapiens
tgaggttttgccaca

SEQ ID NO: 78347 - DNA, 15 bp, Homo sapiens
gaggttttgccacat

SEQ ID NO: 78348 - DNA, 15 bp, Homo sapiens
aggttttgccacatt

SEQ ID NO: 78349 - DNA, 15 bp, Homo sapiens
ggttttgccacattg

SEQ ID NO: 78350 - DNA, 15 bp, Homo sapiens
gttttgccacattgg

SEQ ID NO: 78351 - DNA, 15 bp, Homo sapiens
ttttgccacattggc

SEQ ID NO: 78352 - DNA, 15 bp, Homo sapiens
tttgccacattggcc

SEQ ID NO: 78353 - DNA, 15 bp, Homo sapiens
ttgccacattggcca

SEQ ID NO: 78354 - DNA, 15 bp, Homo sapiens
tgccacattggccag

SEQ ID NO: 78355 - DNA, 15 bp, Homo sapiens
gccacattggccagg

SEQ ID NO: 78356 - DNA, 15 bp, Homo sapiens
ccacattggccaggc

SEQ ID NO: 78357 - DNA, 15 bp, Homo sapiens
cacattggccaggct

SEQ ID NO: 78358 - DNA, 15 bp, Homo sapiens
acattggccaggcta

SEQ ID NO: 78359 - DNA, 15 bp, Homo sapiens
cattggccaggctag

SEQ ID NO: 78360 - DNA, 15 bp, Homo sapiens
attggccaggctagt

SEQ ID NO: 78361 - DNA, 15 bp, Homo sapiens
aggctagtctcgaac

SEQ ID NO: 78362 - DNA, 15 bp, Homo sapiens
ggctagtctcgaact

SEQ ID NO: 78363 - DNA, 15 bp, Homo sapiens
gctagtctcgaactc

SEQ ID NO: 78364 - DNA, 15 bp, Homo sapiens
ctagtctcgaactcc

SEQ ID NO: 78365 - DNA, 15 bp, Homo sapiens
tagtctcgaactcct

SEQ ID NO: 78366 - DNA, 15 bp, Homo sapiens
agtctcgaactcctg

SEQ ID NO: 78367 - DNA, 15 bp, Homo sapiens
tcgaactcctgaccc

SEQ ID NO: 78368 - DNA, 15 bp, Homo sapiens
cgaactcctgacccc

SEQ ID NO: 78369 - DNA, 15 bp, Homo sapiens
gaactcctgacccca

SEQ ID NO: 78370 - DNA, 15 bp, Homo sapiens
aactcctgaccccag

SEQ ID NO: 78371 - DNA, 15 bp, Homo sapiens
actcctgaccccagg

SEQ ID NO: 78372 - DNA, 15 bp, Homo sapiens
ctcctgaccccaggt

SEQ ID NO: 78373 - DNA, 15 bp, Homo sapiens
tcctgaccccaggtg

SEQ ID NO: 78374 - DNA, 15 bp, Homo sapiens
cctgaccccaggtgg

SEQ ID NO: 78375 - DNA, 15 bp, Homo sapiens
ctgaccccaggtggt

SEQ ID NO: 78376 - DNA, 15 bp, Homo sapiens
tgaccccaggtggtc

SEQ ID NO: 78377 - DNA, 15 bp, Homo sapiens
gaccccaggtggtct

SEQ ID NO: 78378 - DNA, 15 bp, Homo sapiens
accccaggtggtctg

SEQ ID NO: 78379 - DNA, 15 bp, Homo sapiens
ccccaggtggtctgc

SEQ ID NO: 78380 - DNA, 15 bp, Homo sapiens
cccaggtggtctgcg

SEQ ID NO: 78381 - DNA, 15 bp, Homo sapiens
ccaggtggtctgcgc

SEQ ID NO: 78382 - DNA, 15 bp, Homo sapiens
caggtggtctgcgcg

SEQ ID NO: 78383 - DNA, 15 bp, Homo sapiens
aggtggtctgcgcgc

SEQ ID NO: 78384 - DNA, 15 bp, Homo sapiens
ggtggtctgcgcgcc

SEQ ID NO: 78385 - DNA, 15 bp, Homo sapiens
gtggtctgcgcgcct

SEQ ID NO: 78386 - DNA, 15 bp, Homo sapiens
tggtctgcgcgcctc

SEQ ID NO: 78387 - DNA, 15 bp, Homo sapiens
ggtctgcgcgcctca

SEQ ID NO: 78388 - DNA, 15 bp, Homo sapiens
gtctgcgcgcctcag

SEQ ID NO: 78389 - DNA, 15 bp, Homo sapiens
tctgcgcgcctcagc

SEQ ID NO: 78390 - DNA, 15 bp, Homo sapiens
ctgcgcgcctcagcc

SEQ ID NO: 78391 - DNA, 15 bp, Homo sapiens
tgcgcgcctcagcct

SEQ ID NO: 78392 - DNA, 15 bp, Homo sapiens
gcgcgcctcagcctc

SEQ ID NO: 78393 - DNA, 15 bp, Homo sapiens
cgcgcctcagcctcc

SEQ ID NO: 78394 - DNA, 15 bp, Homo sapiens
gcgcctcagcctccc

SEQ ID NO: 78395 - DNA, 15 bp, Homo sapiens
accacgcctggcccg

SEQ ID NO: 78396 - DNA, 15 bp, Homo sapiens
ccacgcctggcccga

SEQ ID NO: 78397 - DNA, 15 bp, Homo sapiens
cacgcctggcccgac

SEQ ID NO: 78398 - DNA, 15 bp, Homo sapiens
acgcctggcccgacc

SEQ ID NO: 78399 - DNA, 15 bp, Homo sapiens
cgcctggcccgaccc

SEQ ID NO: 78400 - DNA, 15 bp, Homo sapiens
gcctggcccgaccca

SEQ ID NO: 78401 - DNA, 15 bp, Homo sapiens
cctggcccgacccaa

SEQ ID NO: 78402 - DNA, 15 bp, Homo sapiens
ctggcccgacccaat

SEQ ID NO: 78403 - DNA, 15 bp, Homo sapiens
tggcccgacccaatg

SEQ ID NO: 78404 - DNA, 15 bp, Homo sapiens
ggcccgacccaatgt

SEQ ID NO: 78405 - DNA, 15 bp, Homo sapiens
gcccgacccaatgtt

SEQ ID NO: 78406 - DNA, 15 bp, Homo sapiens
cccgacccaatgttt

SEQ ID NO: 78407 - DNA, 15 bp, Homo sapiens
ccgacccaatgtttt

SEQ ID NO: 78408 - DNA, 15 bp, Homo sapiens
cgacccaatgttttc

SEQ ID NO: 78409 - DNA, 15 bp, Homo sapiens
gacccaatgttttct

SEQ ID NO: 78410 - DNA, 15 bp, Homo sapiens
acccaatgttttcta

SEQ ID NO: 78411 - DNA, 15 bp, Homo sapiens
cccaatgttttctat

SEQ ID NO: 78412 - DNA, 15 bp, Homo sapiens
ccaatgttttctata

SEQ ID NO: 78413 - DNA, 15 bp, Homo sapiens
caatgttttctatag

SEQ ID NO: 78414 - DNA, 15 bp, Homo sapiens
aatgttttctataga

SEQ ID NO: 78415 - DNA, 15 bp, Homo sapiens
atgttttctatagag

SEQ ID NO: 78416 - DNA, 15 bp, Homo sapiens
tgttttctatagagc

SEQ ID NO: 78417 - DNA, 15 bp, Homo sapiens
gttttctatagagct

SEQ ID NO: 78418 - DNA, 15 bp, Homo sapiens
ttttctatagagctc

SEQ ID NO: 78419 - DNA, 15 bp, Homo sapiens
tttctatagagctct

SEQ ID NO: 78420 - DNA, 15 bp, Homo sapiens
ttctatagagctctt

SEQ ID NO: 78421 - DNA, 15 bp, Homo sapiens
tctatagagctcttt

SEQ ID NO: 78422 - DNA, 15 bp, Homo sapiens
ctatagagctctttc

SEQ ID NO: 78423 - DNA, 15 bp, Homo sapiens
tatagagctctttcc

SEQ ID NO: 78424 - DNA, 15 bp, Homo sapiens
atagagctctttccc

SEQ ID NO: 78425 - DNA, 15 bp, Homo sapiens
tagagctctttccca

SEQ ID NO: 78426 - DNA, 15 bp, Homo sapiens
agagctctttcccag

SEQ ID NO: 78427 - DNA, 15 bp, Homo sapiens
gagctctttcccagg

SEQ ID NO: 78428 - DNA, 15 bp, Homo sapiens
agctctttcccaggc

SEQ ID NO: 78429 - DNA, 15 bp, Homo sapiens
gctctttcccaggcc

SEQ ID NO: 78430 - DNA, 15 bp, Homo sapiens
ctctttcccaggcct

SEQ ID NO: 78431 - DNA, 15 bp, Homo sapiens
tctttcccaggcctc

SEQ ID NO: 78432 - DNA, 15 bp, Homo sapiens
ctttcccaggcctct

SEQ ID NO: 78433 - DNA, 15 bp, Homo sapiens
tttcccaggcctctc

SEQ ID NO: 78434 - DNA, 15 bp, Homo sapiens
ttcccaggcctctcc

SEQ ID NO: 78435 - DNA, 15 bp, Homo sapiens
tcccaggcctctccc

SEQ ID NO: 78436 - DNA, 15 bp, Homo sapiens
cccaggcctctcccc

SEQ ID NO: 78437 - DNA, 15 bp, Homo sapiens
ccaggcctctcccct

SEQ ID NO: 78438 - DNA, 15 bp, Homo sapiens
caggcctctcccctt

SEQ ID NO: 78439 - DNA, 15 bp, Homo sapiens
aggcctctccccttt

SEQ ID NO: 78440 - DNA, 15 bp, Homo sapiens
ggcctctcccctttg

SEQ ID NO: 78441 - DNA, 15 bp, Homo sapiens
gcctctcccctttgc

SEQ ID NO: 78442 - DNA, 15 bp, Homo sapiens
cctctcccctttgca

SEQ ID NO: 78443 - DNA, 15 bp, Homo sapiens
ctctcccctttgcaa

SEQ ID NO: 78444 - DNA, 15 bp, Homo sapiens
tctcccctttgcaag

SEQ ID NO: 78445 - DNA, 15 bp, Homo sapiens
ctcccctttgcaagc

SEQ ID NO: 78446 - DNA, 15 bp, Homo sapiens
tcccctttgcaagca

SEQ ID NO: 78447 - DNA, 15 bp, Homo sapiens
cccctttgcaagcag

SEQ ID NO: 78448 - DNA, 15 bp, Homo sapiens
ccctttgcaagcagc

SEQ ID NO: 78449 - DNA, 15 bp, Homo sapiens
cctttgcaagcagcg

SEQ ID NO: 78450 - DNA, 15 bp, Homo sapiens
ctttgcaagcagcgt

SEQ ID NO: 78451 - DNA, 15 bp, Homo sapiens
tttgcaagcagcgta

SEQ ID NO: 78452 - DNA, 15 bp, Homo sapiens
ttgcaagcagcgtag

SEQ ID NO: 78453 - DNA, 15 bp, Homo sapiens
tgcaagcagcgtagc

SEQ ID NO: 78454 - DNA, 15 bp, Homo sapiens
gcaagcagcgtagct

SEQ ID NO: 78455 - DNA, 15 bp, Homo sapiens
caagcagcgtagctg

SEQ ID NO: 78456 - DNA, 15 bp, Homo sapiens
aagcagcgtagctgg

SEQ ID NO: 78457 - DNA, 15 bp, Homo sapiens
agcagcgtagctgga

SEQ ID NO: 78458 - DNA, 15 bp, Homo sapiens
gcagcgtagctggag

SEQ ID NO: 78459 - DNA, 15 bp, Homo sapiens
cagcgtagctggagg

SEQ ID NO: 78460 - DNA, 15 bp, Homo sapiens
agcgtagctggaggg

SEQ ID NO: 78461 - DNA, 15 bp, Homo sapiens
gcgtagctggagggt

SEQ ID NO: 78462 - DNA, 15 bp, Homo sapiens
cgtagctggagggtc

SEQ ID NO: 78463 - DNA, 15 bp, Homo sapiens
gtagctggagggtct

SEQ ID NO: 78464 - DNA, 15 bp, Homo sapiens
tagctggagggtctc

SEQ ID NO: 78465 - DNA, 15 bp, Homo sapiens
agctggagggtctca

SEQ ID NO: 78466 - DNA, 15 bp, Homo sapiens
gctggagggtctcat

SEQ ID NO: 78467 - DNA, 15 bp, Homo sapiens
ctggagggtctcatc

SEQ ID NO: 78468 - DNA, 15 bp, Homo sapiens
tggagggtctcatca

SEQ ID NO: 78469 - DNA, 15 bp, Homo sapiens
ggagggtctcatcag

SEQ ID NO: 78470 - DNA, 15 bp, Homo sapiens
gagggtctcatcagc

SEQ ID NO: 78471 - DNA, 15 bp, Homo sapiens
agggtctcatcagca

SEQ ID NO: 78472 - DNA, 15 bp, Homo sapiens
gggtctcatcagcaa

SEQ ID NO: 78473 - DNA, 15 bp, Homo sapiens
ggtctcatcagcaag

SEQ ID NO: 78474 - DNA, 15 bp, Homo sapiens
gtctcatcagcaagc

SEQ ID NO: 78475 - DNA, 15 bp, Homo sapiens
tctcatcagcaagcc

SEQ ID NO: 78476 - DNA, 15 bp, Homo sapiens
ctcatcagcaagccc

SEQ ID NO: 78477 - DNA, 15 bp, Homo sapiens
tcatcagcaagcccc

SEQ ID NO: 78478 - DNA, 15 bp, Homo sapiens
catcagcaagccccg

SEQ ID NO: 78479 - DNA, 15 bp, Homo sapiens
atcagcaagccccgg

SEQ ID NO: 78480 - DNA, 15 bp, Homo sapiens
tcagcaagccccgga

SEQ ID NO: 78481 - DNA, 15 bp, Homo sapiens
cagcaagccccggag

SEQ ID NO: 78482 - DNA, 15 bp, Homo sapiens
agcaagccccggagg

SEQ ID NO: 78483 - DNA, 15 bp, Homo sapiens
gcaagccccggaggc

SEQ ID NO: 78484 - DNA, 15 bp, Homo sapiens
caagccccggaggcg

SEQ ID NO: 78485 - DNA, 15 bp, Homo sapiens
aagccccggaggcga

SEQ ID NO: 78486 - DNA, 15 bp, Homo sapiens
agccccggaggcgag

SEQ ID NO: 78487 - DNA, 15 bp, Homo sapiens
gccccggaggcgagg

SEQ ID NO: 78488 - DNA, 15 bp, Homo sapiens
ccccggaggcgaggg

SEQ ID NO: 78489 - DNA, 15 bp, Homo sapiens
cccggaggcgagggg

SEQ ID NO: 78490 - DNA, 15 bp, Homo sapiens
ccggaggcgaggggg

SEQ ID NO: 78491 - DNA, 15 bp, Homo sapiens
cggaggcgagggggt

SEQ ID NO: 78492 - DNA, 15 bp, Homo sapiens
ggaggcgagggggtc

SEQ ID NO: 78493 - DNA, 15 bp, Homo sapiens
gaggcgagggggtct

SEQ ID NO: 78494 - DNA, 15 bp, Homo sapiens
aggcgagggggtctg

SEQ ID NO: 78495 - DNA, 15 bp, Homo sapiens
ggcgagggggtctgg

SEQ ID NO: 78496 - DNA, 15 bp, Homo sapiens
gcgagggggtctggg

SEQ ID NO: 78497 - DNA, 15 bp, Homo sapiens
cgagggggtctgggg

SEQ ID NO: 78498 - DNA, 15 bp, Homo sapiens
gagggggtctggggc

SEQ ID NO: 78499 - DNA, 15 bp, Homo sapiens
agggggtctggggct

SEQ ID NO: 78500 - DNA, 15 bp, Homo sapiens
gggggtctggggcta

SEQ ID NO: 78501 - DNA, 15 bp, Homo sapiens
ggggtctggggctac

SEQ ID NO: 78502 - DNA, 15 bp, Homo sapiens
gggtctggggctacc

SEQ ID NO: 78503 - DNA, 15 bp, Homo sapiens
ggtctggggctacca

SEQ ID NO: 78504 - DNA, 15 bp, Homo sapiens
gtctggggctaccag

SEQ ID NO: 78505 - DNA, 15 bp, Homo sapiens
tctggggctaccagc

SEQ ID NO: 78506 - DNA, 15 bp, Homo sapiens
ctggggctaccagct

SEQ ID NO: 78507 - DNA, 15 bp, Homo sapiens
tggggctaccagctg

SEQ ID NO: 78508 - DNA, 15 bp, Homo sapiens
ggggctaccagctgg

SEQ ID NO: 78509 - DNA, 15 bp, Homo sapiens
gggctaccagctgga

SEQ ID NO: 78510 - DNA, 15 bp, Homo sapiens
ggctaccagctggac

SEQ ID NO: 78511 - DNA, 15 bp, Homo sapiens
gctaccagctggacc

SEQ ID NO: 78512 - DNA, 15 bp, Homo sapiens
ctaccagctggacca

SEQ ID NO: 78513 - DNA, 15 bp, Homo sapiens
taccagctggaccac

SEQ ID NO: 78514 - DNA, 15 bp, Homo sapiens
accagctggaccacc

SEQ ID NO: 78515 - DNA, 15 bp, Homo sapiens
ccagctggaccacct

SEQ ID NO: 78516 - DNA, 15 bp, Homo sapiens
cagctggaccaccta

SEQ ID NO: 78517 - DNA, 15 bp, Homo sapiens
agctggaccacctac

SEQ ID NO: 78518 - DNA, 15 bp, Homo sapiens
gctggaccacctaca

SEQ ID NO: 78519 - DNA, 15 bp, Homo sapiens
ctggaccacctacag

SEQ ID NO: 78520 - DNA, 15 bp, Homo sapiens
tggaccacctacagc

SEQ ID NO: 78521 - DNA, 15 bp, Homo sapiens
ggaccacctacagct

SEQ ID NO: 78522 - DNA, 15 bp, Homo sapiens
gaccacctacagctg

SEQ ID NO: 78523 - DNA, 15 bp, Homo sapiens
accacctacagctga

SEQ ID NO: 78524 - DNA, 15 bp, Homo sapiens
ccacctacagctgag

SEQ ID NO: 78525 - DNA, 15 bp, Homo sapiens
cacctacagctgagg

SEQ ID NO: 78526 - DNA, 15 bp, Homo sapiens
acctacagctgaggg

SEQ ID NO: 78527 - DNA, 15 bp, Homo sapiens
cctacagctgaggga

SEQ ID NO: 78528 - DNA, 15 bp, Homo sapiens
ctacagctgagggag

SEQ ID NO: 78529 - DNA, 15 bp, Homo sapiens
tacagctgagggagg

SEQ ID NO: 78530 - DNA, 15 bp, Homo sapiens
acagctgagggaggg

SEQ ID NO: 78531 - DNA, 15 bp, Homo sapiens
cagctgagggagggc

SEQ ID NO: 78532 - DNA, 15 bp, Homo sapiens
agctgagggagggcc

SEQ ID NO: 78533 - DNA, 15 bp, Homo sapiens
gctgagggagggccc

SEQ ID NO: 78534 - DNA, 15 bp, Homo sapiens
ctgagggagggcccc

SEQ ID NO: 78535 - DNA, 15 bp, Homo sapiens
tgagggagggccccc

SEQ ID NO: 78536 - DNA, 15 bp, Homo sapiens
gagggagggccccct

SEQ ID NO: 78537 - DNA, 15 bp, Homo sapiens
agggagggccccctt

SEQ ID NO: 78538 - DNA, 15 bp, Homo sapiens
gggagggcccccttg

SEQ ID NO: 78539 - DNA, 15 bp, Homo sapiens
ggagggcccccttgc

SEQ ID NO: 78540 - DNA, 15 bp, Homo sapiens
gagggcccccttgcc

SEQ ID NO: 78541 - DNA, 15 bp, Homo sapiens
agggcccccttgcct

SEQ ID NO: 78542 - DNA, 15 bp, Homo sapiens
gggcccccttgcctc

SEQ ID NO: 78543 - DNA, 15 bp, Homo sapiens
ggcccccttgcctcc

SEQ ID NO: 78544 - DNA, 15 bp, Homo sapiens
gcccccttgcctcct

SEQ ID NO: 78545 - DNA, 15 bp, Homo sapiens
cccccttgcctcctc

SEQ ID NO: 78546 - DNA, 15 bp, Homo sapiens
ccccttgcctcctcc

SEQ ID NO: 78547 - DNA, 15 bp, Homo sapiens
cccttgcctcctcct

SEQ ID NO: 78548 - DNA, 15 bp, Homo sapiens
ccttgcctcctcctg

SEQ ID NO: 78549 - DNA, 15 bp, Homo sapiens
cttgcctcctcctgc

SEQ ID NO: 78550 - DNA, 15 bp, Homo sapiens
ttgcctcctcctgca

SEQ ID NO: 78551 - DNA, 15 bp, Homo sapiens
tgcctcctcctgcat

SEQ ID NO: 78552 - DNA, 15 bp, Homo sapiens
gcctcctcctgcatg

SEQ ID NO: 78553 - DNA, 15 bp, Homo sapiens
cctcctcctgcatgc

SEQ ID NO: 78554 - DNA, 15 bp, Homo sapiens
ctcctcctgcatgct

SEQ ID NO: 78555 - DNA, 15 bp, Homo sapiens
tcctcctgcatgctg

SEQ ID NO: 78556 - DNA, 15 bp, Homo sapiens
cctcctgcatgctgc

SEQ ID NO: 78557 - DNA, 15 bp, Homo sapiens
ctcctgcatgctgcg

SEQ ID NO: 78558 - DNA, 15 bp, Homo sapiens
tcctgcatgctgcgt

SEQ ID NO: 78559 - DNA, 15 bp, Homo sapiens
cctgcatgctgcgtt

SEQ ID NO: 78560 - DNA, 15 bp, Homo sapiens
ctgcatgctgcgttt

SEQ ID NO: 78561 - DNA, 15 bp, Homo sapiens
tgcatgctgcgtttg

SEQ ID NO: 78562 - DNA, 15 bp, Homo sapiens
gcatgctgcgtttgg

SEQ ID NO: 78563 - DNA, 15 bp, Homo sapiens
catgctgcgtttggg

SEQ ID NO: 78564 - DNA, 15 bp, Homo sapiens
atgctgcgtttgggg

SEQ ID NO: 78565 - DNA, 15 bp, Homo sapiens
tgctgcgtttgggga

SEQ ID NO: 78566 - DNA, 15 bp, Homo sapiens
gctgcgtttggggag

SEQ ID NO: 78567 - DNA, 15 bp, Homo sapiens
ctgcgtttggggaga

SEQ ID NO: 78568 - DNA, 15 bp, Homo sapiens
tgcgtttggggagag

SEQ ID NO: 78569 - DNA, 15 bp, Homo sapiens
gcgtttggggagagc

SEQ ID NO: 78570 - DNA, 15 bp, Homo sapiens
cgtttggggagagcg

SEQ ID NO: 78571 - DNA, 15 bp, Homo sapiens
gtttggggagagcgg

SEQ ID NO: 78572 - DNA, 15 bp, Homo sapiens
tttggggagagcggg

SEQ ID NO: 78573 - DNA, 15 bp, Homo sapiens
ttggggagagcggga

SEQ ID NO: 78574 - DNA, 15 bp, Homo sapiens
tggggagagcgggaa

SEQ ID NO: 78575 - DNA, 15 bp, Homo sapiens
ggggagagcgggaag

SEQ ID NO: 78576 - DNA, 15 bp, Homo sapiens
gggagagcgggaaga

SEQ ID NO: 78577 - DNA, 15 bp, Homo sapiens
ggagagcgggaagaa

SEQ ID NO: 78578 - DNA, 15 bp, Homo sapiens
gagagcgggaagaat

SEQ ID NO: 78579 - DNA, 15 bp, Homo sapiens
agagcgggaagaatg

SEQ ID NO: 78580 - DNA, 15 bp, Homo sapiens
gagcgggaagaatgc

SEQ ID NO: 78581 - DNA, 15 bp, Homo sapiens
agcgggaagaatgcc

SEQ ID NO: 78582 - DNA, 15 bp, Homo sapiens
gcgggaagaatgcct

SEQ ID NO: 78583 - DNA, 15 bp, Homo sapiens
cgggaagaatgcctt

SEQ ID NO: 78584 - DNA, 15 bp, Homo sapiens
gggaagaatgccttc

SEQ ID NO: 78585 - DNA, 15 bp, Homo sapiens
ggaagaatgccttca

SEQ ID NO: 78586 - DNA, 15 bp, Homo sapiens
gaagaatgccttcaa

SEQ ID NO: 78587 - DNA, 15 bp, Homo sapiens
aagaatgccttcaag

SEQ ID NO: 78588 - DNA, 15 bp, Homo sapiens
agaatgccttcaagg

SEQ ID NO: 78589 - DNA, 15 bp, Homo sapiens
gaatgccttcaagga

SEQ ID NO: 78590 - DNA, 15 bp, Homo sapiens
aatgccttcaaggac

SEQ ID NO: 78591 - DNA, 15 bp, Homo sapiens
atgccttcaaggact

SEQ ID NO: 78592 - DNA, 15 bp, Homo sapiens
tgccttcaaggactt

SEQ ID NO: 78593 - DNA, 15 bp, Homo sapiens
gccttcaaggacttc

SEQ ID NO: 78594 - DNA, 15 bp, Homo sapiens
ccttcaaggacttcc

SEQ ID NO: 78595 - DNA, 15 bp, Homo sapiens
cttcaaggacttccc

SEQ ID NO: 78596 - DNA, 15 bp, Homo sapiens
ttcaaggacttcccg

SEQ ID NO: 78597 - DNA, 15 bp, Homo sapiens
tcaaggacttcccga

SEQ ID NO: 78598 - DNA, 15 bp, Homo sapiens
caaggacttcccgac

SEQ ID NO: 78599 - DNA, 15 bp, Homo sapiens
aaggacttcccgacc

SEQ ID NO: 78600 - DNA, 15 bp, Homo sapiens
aggacttcccgacca

SEQ ID NO: 78601 - DNA, 15 bp, Homo sapiens
ggacttcccgaccac

SEQ ID NO: 78602 - DNA, 15 bp, Homo sapiens
gacttcccgaccacc

SEQ ID NO: 78603 - DNA, 15 bp, Homo sapiens
acttcccgaccacca

SEQ ID NO: 78604 - DNA, 15 bp, Homo sapiens
cttcccgaccaccag

SEQ ID NO: 78605 - DNA, 15 bp, Homo sapiens
ttcccgaccaccagg

SEQ ID NO: 78606 - DNA, 15 bp, Homo sapiens
tcccgaccaccaggg

SEQ ID NO: 78607 - DNA, 15 bp, Homo sapiens
cccgaccaccaggga

SEQ ID NO: 78608 - DNA, 15 bp, Homo sapiens
ccgaccaccagggac

SEQ ID NO: 78609 - DNA, 15 bp, Homo sapiens
cgaccaccagggaca

SEQ ID NO: 78610 - DNA, 15 bp, Homo sapiens
gaccaccagggacaa

SEQ ID NO: 78611 - DNA, 15 bp, Homo sapiens
accaccagggacaaa

SEQ ID NO: 78612 - DNA, 15 bp, Homo sapiens
ccaccagggacaaag

SEQ ID NO: 78613 - DNA, 15 bp, Homo sapiens
caccagggacaaagg

SEQ ID NO: 78614 - DNA, 15 bp, Homo sapiens
accagggacaaaggg

SEQ ID NO: 78615 - DNA, 15 bp, Homo sapiens
ccagggacaaaggga

SEQ ID NO: 78616 - DNA, 15 bp, Homo sapiens
cagggacaaagggat

SEQ ID NO: 78617 - DNA, 15 bp, Homo sapiens
agggacaaagggatg

SEQ ID NO: 78618 - DNA, 15 bp, Homo sapiens
gggacaaagggatga

SEQ ID NO: 78619 - DNA, 15 bp, Homo sapiens
ggacaaagggatgag

SEQ ID NO: 78620 - DNA, 15 bp, Homo sapiens
gacaaagggatgagc

SEQ ID NO: 78621 - DNA, 15 bp, Homo sapiens
acaaagggatgagcc

SEQ ID NO: 78622 - DNA, 15 bp, Homo sapiens
caaagggatgagccc

SEQ ID NO: 78623 - DNA, 15 bp, Homo sapiens
aaagggatgagccct

SEQ ID NO: 78624 - DNA, 15 bp, Homo sapiens
aagggatgagccctg

SEQ ID NO: 78625 - DNA, 15 bp, Homo sapiens
agggatgagccctgg

SEQ ID NO: 78626 - DNA, 15 bp, Homo sapiens
gggatgagccctggg

SEQ ID NO: 78627 - DNA, 15 bp, Homo sapiens
ggatgagccctggga

SEQ ID NO: 78628 - DNA, 15 bp, Homo sapiens
gatgagccctgggag

SEQ ID NO: 78629 - DNA, 15 bp, Homo sapiens
atgagccctgggagc

SEQ ID NO: 78630 - DNA, 15 bp, Homo sapiens
tgagccctgggagcc

SEQ ID NO: 78631 - DNA, 15 bp, Homo sapiens
gagccctgggagccg

SEQ ID NO: 78632 - DNA, 15 bp, Homo sapiens
agccctgggagccga

SEQ ID NO: 78633 - DNA, 15 bp, Homo sapiens
gccctgggagccgaa

SEQ ID NO: 78634 - DNA, 15 bp, Homo sapiens
ccctgggagccgaag

SEQ ID NO: 78635 - DNA, 15 bp, Homo sapiens
cctgggagccgaagc

SEQ ID NO: 78636 - DNA, 15 bp, Homo sapiens
ctgggagccgaagcc

SEQ ID NO: 78637 - DNA, 15 bp, Homo sapiens
tgggagccgaagccc

SEQ ID NO: 78638 - DNA, 15 bp, Homo sapiens
gggagccgaagccca

SEQ ID NO: 78639 - DNA, 15 bp, Homo sapiens
ggagccgaagcccag

SEQ ID NO: 78640 - DNA, 15 bp, Homo sapiens
gagccgaagcccagc

SEQ ID NO: 78641 - DNA, 15 bp, Homo sapiens
agccgaagcccagca

SEQ ID NO: 78642 - DNA, 15 bp, Homo sapiens
gccgaagcccagcag

SEQ ID NO: 78643 - DNA, 15 bp, Homo sapiens
ccgaagcccagcaga

SEQ ID NO: 78644 - DNA, 15 bp, Homo sapiens
cgaagcccagcagat

SEQ ID NO: 78645 - DNA, 15 bp, Homo sapiens
gaagcccagcagatt

SEQ ID NO: 78646 - DNA, 15 bp, Homo sapiens
aagcccagcagattc

SEQ ID NO: 78647 - DNA, 15 bp, Homo sapiens
agcccagcagattct

SEQ ID NO: 78648 - DNA, 15 bp, Homo sapiens
gcccagcagattcta

SEQ ID NO: 78649 - DNA, 15 bp, Homo sapiens
cccagcagattctat

SEQ ID NO: 78650 - DNA, 15 bp, Homo sapiens
ccagcagattctatt

SEQ ID NO: 78651 - DNA, 15 bp, Homo sapiens
cagcagattctattg

SEQ ID NO: 78652 - DNA, 15 bp, Homo sapiens
agcagattctattga

SEQ ID NO: 78653 - DNA, 15 bp, Homo sapiens
gcagattctattgaa

SEQ ID NO: 78654 - DNA, 15 bp, Homo sapiens
cagattctattgaac

SEQ ID NO: 78655 - DNA, 15 bp, Homo sapiens
agattctattgaacg

SEQ ID NO: 78656 - DNA, 15 bp, Homo sapiens
gattctattgaacgt

SEQ ID NO: 78657 - DNA, 15 bp, Homo sapiens
attctattgaacgtg

SEQ ID NO: 78658 - DNA, 15 bp, Homo sapiens
ttctattgaacgtgt

SEQ ID NO: 78659 - DNA, 15 bp, Homo sapiens
tctattgaacgtgtc

SEQ ID NO: 78660 - DNA, 15 bp, Homo sapiens
ctattgaacgtgtcc

SEQ ID NO: 78661 - DNA, 15 bp, Homo sapiens
tattgaacgtgtccc

SEQ ID NO: 78662 - DNA, 15 bp, Homo sapiens
attgaacgtgtcccc

SEQ ID NO: 78663 - DNA, 15 bp, Homo sapiens
ttgaacgtgtcccca

SEQ ID NO: 78664 - DNA, 15 bp, Homo sapiens
tgaacgtgtccccag

SEQ ID NO: 78665 - DNA, 15 bp, Homo sapiens
gaacgtgtccccagc

SEQ ID NO: 78666 - DNA, 15 bp, Homo sapiens
aacgtgtccccagcc

SEQ ID NO: 78667 - DNA, 15 bp, Homo sapiens
acgtgtccccagcca

SEQ ID NO: 78668 - DNA, 15 bp, Homo sapiens
cgtgtccccagccat

SEQ ID NO: 78669 - DNA, 15 bp, Homo sapiens
gtgtccccagccatt

SEQ ID NO: 78670 - DNA, 15 bp, Homo sapiens
tgtccccagccattg

SEQ ID NO: 78671 - DNA, 15 bp, Homo sapiens
gtccccagccattgc

SEQ ID NO: 78672 - DNA, 15 bp, Homo sapiens
tccccagccattgct

SEQ ID NO: 78673 - DNA, 15 bp, Homo sapiens
ccccagccattgctt

SEQ ID NO: 78674 - DNA, 15 bp, Homo sapiens
cccagccattgctta

SEQ ID NO: 78675 - DNA, 15 bp, Homo sapiens
ccagccattgcttaa

SEQ ID NO: 78676 - DNA, 15 bp, Homo sapiens
cagccattgcttaag

SEQ ID NO: 78677 - DNA, 15 bp, Homo sapiens
agccattgcttaaga

SEQ ID NO: 78678 - DNA, 15 bp, Homo sapiens
gccattgcttaagaa

SEQ ID NO: 78679 - DNA, 15 bp, Homo sapiens
ccattgcttaagaag

SEQ ID NO: 78680 - DNA, 15 bp, Homo sapiens
cattgcttaagaagt

SEQ ID NO: 78681 - DNA, 15 bp, Homo sapiens
attgcttaagaagtg

SEQ ID NO: 78682 - DNA, 15 bp, Homo sapiens
ttgcttaagaagtgc

SEQ ID NO: 78683 - DNA, 15 bp, Homo sapiens
tgcttaagaagtgca

SEQ ID NO: 78684 - DNA, 15 bp, Homo sapiens
gcttaagaagtgcag

SEQ ID NO: 78685 - DNA, 15 bp, Homo sapiens
cttaagaagtgcagg

SEQ ID NO: 78686 - DNA, 15 bp, Homo sapiens
ttaagaagtgcaggt

SEQ ID NO: 78687 - DNA, 15 bp, Homo sapiens
taagaagtgcaggtc

SEQ ID NO: 78688 - DNA, 15 bp, Homo sapiens
aagaagtgcaggtca

SEQ ID NO: 78689 - DNA, 15 bp, Homo sapiens
agaagtgcaggtcac

SEQ ID NO: 78690 - DNA, 15 bp, Homo sapiens
gaagtgcaggtcacg

SEQ ID NO: 78691 - DNA, 15 bp, Homo sapiens
aagtgcaggtcacgg

SEQ ID NO: 78692 - DNA, 15 bp, Homo sapiens
agtgcaggtcacgga

SEQ ID NO: 78693 - DNA, 15 bp, Homo sapiens
gtgcaggtcacggag

SEQ ID NO: 78694 - DNA, 15 bp, Homo sapiens
tgcaggtcacggaga

SEQ ID NO: 78695 - DNA, 15 bp, Homo sapiens
gcaggtcacggagac

SEQ ID NO: 78696 - DNA, 15 bp, Homo sapiens
caggtcacggagact

SEQ ID NO: 78697 - DNA, 15 bp, Homo sapiens
aggtcacggagactt

SEQ ID NO: 78698 - DNA, 15 bp, Homo sapiens
ggtcacggagacttt

SEQ ID NO: 78699 - DNA, 15 bp, Homo sapiens
gtcacggagactttg

SEQ ID NO: 78700 - DNA, 15 bp, Homo sapiens
tcacggagactttgc

SEQ ID NO: 78701 - DNA, 15 bp, Homo sapiens
cacggagactttgct

SEQ ID NO: 78702 - DNA, 15 bp, Homo sapiens
acggagactttgctc

SEQ ID NO: 78703 - DNA, 15 bp, Homo sapiens
cggagactttgctcc

SEQ ID NO: 78704 - DNA, 15 bp, Homo sapiens
ggagactttgctcct

SEQ ID NO: 78705 - DNA, 15 bp, Homo sapiens
gagactttgctcctc

SEQ ID NO: 78706 - DNA, 15 bp, Homo sapiens
agactttgctcctcg

SEQ ID NO: 78707 - DNA, 15 bp, Homo sapiens
gactttgctcctcgt

SEQ ID NO: 78708 - DNA, 15 bp, Homo sapiens
actttgctcctcgtt

SEQ ID NO: 78709 - DNA, 15 bp, Homo sapiens
ctttgctcctcgttt

SEQ ID NO: 78710 - DNA, 15 bp, Homo sapiens
tttgctcctcgtttt

SEQ ID NO: 78711 - DNA, 15 bp, Homo sapiens
ttgctcctcgttttc

SEQ ID NO: 78712 - DNA, 15 bp, Homo sapiens
tgctcctcgttttcc

SEQ ID NO: 78713 - DNA, 15 bp, Homo sapiens
gctcctcgttttcca

SEQ ID NO: 78714 - DNA, 15 bp, Homo sapiens
ctcctcgttttccag

SEQ ID NO: 78715 - DNA, 15 bp, Homo sapiens
tcctcgttttccaga

SEQ ID NO: 78716 - DNA, 15 bp, Homo sapiens
cctcgttttccagaa

SEQ ID NO: 78717 - DNA, 15 bp, Homo sapiens
ctcgttttccagaag

SEQ ID NO: 78718 - DNA, 15 bp, Homo sapiens
tcgttttccagaagg

SEQ ID NO: 78719 - DNA, 15 bp, Homo sapiens
cgttttccagaaggg

SEQ ID NO: 78720 - DNA, 15 bp, Homo sapiens
gttttccagaagggg

SEQ ID NO: 78721 - DNA, 15 bp, Homo sapiens
ttttccagaaggggg

SEQ ID NO: 78722 - DNA, 15 bp, Homo sapiens
tttccagaaggggga

SEQ ID NO: 78723 - DNA, 15 bp, Homo sapiens
ttccagaagggggaa

SEQ ID NO: 78724 - DNA, 15 bp, Homo sapiens
tccagaagggggaaa

SEQ ID NO: 78725 - DNA, 15 bp, Homo sapiens
ccagaagggggaaac

SEQ ID NO: 78726 - DNA, 15 bp, Homo sapiens
cagaagggggaaact

SEQ ID NO: 78727 - DNA, 15 bp, Homo sapiens
agaagggggaaactg

SEQ ID NO: 78728 - DNA, 15 bp, Homo sapiens
gaagggggaaactga

SEQ ID NO: 78729 - DNA, 15 bp, Homo sapiens
aagggggaaactgag

SEQ ID NO: 78730 - DNA, 15 bp, Homo sapiens
agggggaaactgagg

SEQ ID NO: 78731 - DNA, 15 bp, Homo sapiens
gggggaaactgaggc

SEQ ID NO: 78732 - DNA, 15 bp, Homo sapiens
ggggaaactgaggcc

SEQ ID NO: 78733 - DNA, 15 bp, Homo sapiens
gggaaactgaggcct

SEQ ID NO: 78734 - DNA, 15 bp, Homo sapiens
ggaaactgaggccta

SEQ ID NO: 78735 - DNA, 15 bp, Homo sapiens
gaaactgaggcctag

SEQ ID NO: 78736 - DNA, 15 bp, Homo sapiens
aaactgaggcctaga

SEQ ID NO: 78737 - DNA, 15 bp, Homo sapiens
aactgaggcctagag

SEQ ID NO: 78738 - DNA, 15 bp, Homo sapiens
actgaggcctagaga

SEQ ID NO: 78739 - DNA, 15 bp, Homo sapiens
ctgaggcctagagag

SEQ ID NO: 78740 - DNA, 15 bp, Homo sapiens
tgaggcctagagagt

SEQ ID NO: 78741 - DNA, 15 bp, Homo sapiens
gaggcctagagagtg

SEQ ID NO: 78742 - DNA, 15 bp, Homo sapiens
aggcctagagagtga

SEQ ID NO: 78743 - DNA, 15 bp, Homo sapiens
ggcctagagagtgaa

SEQ ID NO: 78744 - DNA, 15 bp, Homo sapiens
gcctagagagtgaag

SEQ ID NO: 78745 - DNA, 15 bp, Homo sapiens
cctagagagtgaagt

SEQ ID NO: 78746 - DNA, 15 bp, Homo sapiens
ctagagagtgaagtg

SEQ ID NO: 78747 - DNA, 15 bp, Homo sapiens
tagagagtgaagtgg

SEQ ID NO: 78748 - DNA, 15 bp, Homo sapiens
agagagtgaagtggc

SEQ ID NO: 78749 - DNA, 15 bp, Homo sapiens
gagagtgaagtggct

SEQ ID NO: 78750 - DNA, 15 bp, Homo sapiens
agagtgaagtggctg

SEQ ID NO: 78751 - DNA, 15 bp, Homo sapiens
gagtgaagtggctgt

SEQ ID NO: 78752 - DNA, 15 bp, Homo sapiens
agtgaagtggctgtt

SEQ ID NO: 78753 - DNA, 15 bp, Homo sapiens
gtgaagtggctgttc

SEQ ID NO: 78754 - DNA, 15 bp, Homo sapiens
tgaagtggctgttcc

SEQ ID NO: 78755 - DNA, 15 bp, Homo sapiens
gaagtggctgttcca

SEQ ID NO: 78756 - DNA, 15 bp, Homo sapiens
aagtggctgttccag

SEQ ID NO: 78757 - DNA, 15 bp, Homo sapiens
agtggctgttccagg

SEQ ID NO: 78758 - DNA, 15 bp, Homo sapiens
gtggctgttccaggc

SEQ ID NO: 78759 - DNA, 15 bp, Homo sapiens
tggctgttccaggct

SEQ ID NO: 78760 - DNA, 15 bp, Homo sapiens
ggctgttccaggctg

SEQ ID NO: 78761 - DNA, 15 bp, Homo sapiens
gctgttccaggctgc

SEQ ID NO: 78762 - DNA, 15 bp, Homo sapiens
ctgttccaggctgca

SEQ ID NO: 78763 - DNA, 15 bp, Homo sapiens
tgttccaggctgcac

SEQ ID NO: 78764 - DNA, 15 bp, Homo sapiens
gttccaggctgcacg

SEQ ID NO: 78765 - DNA, 15 bp, Homo sapiens
ttccaggctgcacgg

SEQ ID NO: 78766 - DNA, 15 bp, Homo sapiens
tccaggctgcacggt

SEQ ID NO: 78767 - DNA, 15 bp, Homo sapiens
ccaggctgcacggtg

SEQ ID NO: 78768 - DNA, 15 bp, Homo sapiens
caggctgcacggtga

SEQ ID NO: 78769 - DNA, 15 bp, Homo sapiens
aggctgcacggtgac

SEQ ID NO: 78770 - DNA, 15 bp, Homo sapiens
ggctgcacggtgaca

SEQ ID NO: 78771 - DNA, 15 bp, Homo sapiens
gctgcacggtgacag

SEQ ID NO: 78772 - DNA, 15 bp, Homo sapiens
ctgcacggtgacagg

SEQ ID NO: 78773 - DNA, 15 bp, Homo sapiens
tgcacggtgacaggt

SEQ ID NO: 78774 - DNA, 15 bp, Homo sapiens
gcacggtgacaggta

SEQ ID NO: 78775 - DNA, 15 bp, Homo sapiens
cacggtgacaggtag

SEQ ID NO: 78776 - DNA, 15 bp, Homo sapiens
acggtgacaggtaga

SEQ ID NO: 78777 - DNA, 15 bp, Homo sapiens
cggtgacaggtagaa

SEQ ID NO: 78778 - DNA, 15 bp, Homo sapiens
ggtgacaggtagaag

SEQ ID NO: 78779 - DNA, 15 bp, Homo sapiens
gtgacaggtagaagg

SEQ ID NO: 78780 - DNA, 15 bp, Homo sapiens
tgacaggtagaagga

SEQ ID NO: 78781 - DNA, 15 bp, Homo sapiens
gacaggtagaaggat

SEQ ID NO: 78782 - DNA, 15 bp, Homo sapiens
acaggtagaaggatg

SEQ ID NO: 78783 - DNA, 15 bp, Homo sapiens
caggtagaaggatgg

SEQ ID NO: 78784 - DNA, 15 bp, Homo sapiens
aggtagaaggatggt

SEQ ID NO: 78785 - DNA, 15 bp, Homo sapiens
ggtagaaggatggtt

SEQ ID NO: 78786 - DNA, 15 bp, Homo sapiens
gtagaaggatggttg

SEQ ID NO: 78787 - DNA, 15 bp, Homo sapiens
tagaaggatggttgg

SEQ ID NO: 78788 - DNA, 15 bp, Homo sapiens
agaaggatggttggg

SEQ ID NO: 78789 - DNA, 15 bp, Homo sapiens
gaaggatggttggga

SEQ ID NO: 78790 - DNA, 15 bp, Homo sapiens
aaggatggttgggat

SEQ ID NO: 78791 - DNA, 15 bp, Homo sapiens
aggatggttgggatc

SEQ ID NO: 78792 - DNA, 15 bp, Homo sapiens
ggatggttgggatca

SEQ ID NO: 78793 - DNA, 15 bp, Homo sapiens
gatggttgggatcaa

SEQ ID NO: 78794 - DNA, 15 bp, Homo sapiens
atggttgggatcaag

SEQ ID NO: 78795 - DNA, 15 bp, Homo sapiens
tggttgggatcaagg

SEQ ID NO: 78796 - DNA, 15 bp, Homo sapiens
ggttgggatcaagga

SEQ ID NO: 78797 - DNA, 15 bp, Homo sapiens
gttgggatcaaggaa

SEQ ID NO: 78798 - DNA, 15 bp, Homo sapiens
ttgggatcaaggaac

SEQ ID NO: 78799 - DNA, 15 bp, Homo sapiens
tgggatcaaggaacg

SEQ ID NO: 78800 - DNA, 15 bp, Homo sapiens
gggatcaaggaacgg

SEQ ID NO: 78801 - DNA, 15 bp, Homo sapiens
ggatcaaggaacggc

SEQ ID NO: 78802 - DNA, 15 bp, Homo sapiens
gatcaaggaacggcc

SEQ ID NO: 78803 - DNA, 15 bp, Homo sapiens
atcaaggaacggcca

SEQ ID NO: 78804 - DNA, 15 bp, Homo sapiens
tcaaggaacggccat

SEQ ID NO: 78805 - DNA, 15 bp, Homo sapiens
caaggaacggccatc

SEQ ID NO: 78806 - DNA, 15 bp, Homo sapiens
aaggaacggccatcc

SEQ ID NO: 78807 - DNA, 15 bp, Homo sapiens
aggaacggccatcca

SEQ ID NO: 78808 - DNA, 15 bp, Homo sapiens
ggaacggccatccag

SEQ ID NO: 78809 - DNA, 15 bp, Homo sapiens
gaacggccatccagc

SEQ ID NO: 78810 - DNA, 15 bp, Homo sapiens
aacggccatccagca

SEQ ID NO: 78811 - DNA, 15 bp, Homo sapiens
acggccatccagcaa

SEQ ID NO: 78812 - DNA, 15 bp, Homo sapiens
cggccatccagcaac

SEQ ID NO: 78813 - DNA, 15 bp, Homo sapiens
ggccatccagcaacc

SEQ ID NO: 78814 - DNA, 15 bp, Homo sapiens
gccatccagcaacct

SEQ ID NO: 78815 - DNA, 15 bp, Homo sapiens
ccatccagcaacctc

SEQ ID NO: 78816 - DNA, 15 bp, Homo sapiens
catccagcaacctcc

SEQ ID NO: 78817 - DNA, 15 bp, Homo sapiens
atccagcaacctccc

SEQ ID NO: 78818 - DNA, 15 bp, Homo sapiens
tccagcaacctcccc

SEQ ID NO: 78819 - DNA, 15 bp, Homo sapiens
ccagcaacctcccct

SEQ ID NO: 78820 - DNA, 15 bp, Homo sapiens
cagcaacctcccctg

SEQ ID NO: 78821 - DNA, 15 bp, Homo sapiens
agcaacctcccctgt

SEQ ID NO: 78822 - DNA, 15 bp, Homo sapiens
gcaacctcccctgtc

SEQ ID NO: 78823 - DNA, 15 bp, Homo sapiens
caacctcccctgtcc

SEQ ID NO: 78824 - DNA, 15 bp, Homo sapiens
aacctcccctgtccc

SEQ ID NO: 78825 - DNA, 15 bp, Homo sapiens
acctcccctgtcccc

SEQ ID NO: 78826 - DNA, 15 bp, Homo sapiens
cctcccctgtccccc

SEQ ID NO: 78827 - DNA, 15 bp, Homo sapiens
ctcccctgtccccct

SEQ ID NO: 78828 - DNA, 15 bp, Homo sapiens
tcccctgtccccctt

SEQ ID NO: 78829 - DNA, 15 bp, Homo sapiens
cccctgtcccccttt

SEQ ID NO: 78830 - DNA, 15 bp, Homo sapiens
ccctgtccccctttg

SEQ ID NO: 78831 - DNA, 15 bp, Homo sapiens
cctgtccccctttgc

SEQ ID NO: 78832 - DNA, 15 bp, Homo sapiens
ctgtccccctttgcc

SEQ ID NO: 78833 - DNA, 15 bp, Homo sapiens
tgtccccctttgcca

SEQ ID NO: 78834 - DNA, 15 bp, Homo sapiens
gtccccctttgccac

SEQ ID NO: 78835 - DNA, 15 bp, Homo sapiens
tccccctttgccacc

SEQ ID NO: 78836 - DNA, 15 bp, Homo sapiens
ccccctttgccaccc

SEQ ID NO: 78837 - DNA, 15 bp, Homo sapiens
cccctttgccacccc

SEQ ID NO: 78838 - DNA, 15 bp, Homo sapiens
ccctttgccacccca

SEQ ID NO: 78839 - DNA, 15 bp, Homo sapiens
cctttgccaccccag

SEQ ID NO: 78840 - DNA, 15 bp, Homo sapiens
ctttgccaccccaga

SEQ ID NO: 78841 - DNA, 15 bp, Homo sapiens
tttgccaccccagac

SEQ ID NO: 78842 - DNA, 15 bp, Homo sapiens
ttgccaccccagacc

SEQ ID NO: 78843 - DNA, 15 bp, Homo sapiens
tgccaccccagaccc

SEQ ID NO: 78844 - DNA, 15 bp, Homo sapiens
gccaccccagaccca

SEQ ID NO: 78845 - DNA, 15 bp, Homo sapiens
ccaccccagacccag

SEQ ID NO: 78846 - DNA, 15 bp, Homo sapiens
caccccagacccagg

SEQ ID NO: 78847 - DNA, 15 bp, Homo sapiens
accccagacccaggc

SEQ ID NO: 78848 - DNA, 15 bp, Homo sapiens
ccccagacccaggcc

SEQ ID NO: 78849 - DNA, 15 bp, Homo sapiens
cccagacccaggcct

SEQ ID NO: 78850 - DNA, 15 bp, Homo sapiens
ccagacccaggcctg

SEQ ID NO: 78851 - DNA, 15 bp, Homo sapiens
cagacccaggcctgc

SEQ ID NO: 78852 - DNA, 15 bp, Homo sapiens
agacccaggcctgcc

SEQ ID NO: 78853 - DNA, 15 bp, Homo sapiens
gacccaggcctgccc

SEQ ID NO: 78854 - DNA, 15 bp, Homo sapiens
acccaggcctgccca

SEQ ID NO: 78855 - DNA, 15 bp, Homo sapiens
cccaggcctgcccac

SEQ ID NO: 78856 - DNA, 15 bp, Homo sapiens
ccaggcctgcccacc

SEQ ID NO: 78857 - DNA, 15 bp, Homo sapiens
caggcctgcccacct

SEQ ID NO: 78858 - DNA, 15 bp, Homo sapiens
aggcctgcccacctc

SEQ ID NO: 78859 - DNA, 15 bp, Homo sapiens
ggcctgcccacctct

SEQ ID NO: 78860 - DNA, 15 bp, Homo sapiens
gcctgcccacctctc

SEQ ID NO: 78861 - DNA, 15 bp, Homo sapiens
cctgcccacctctct

SEQ ID NO: 78862 - DNA, 15 bp, Homo sapiens
ctgcccacctctctc

SEQ ID NO: 78863 - DNA, 15 bp, Homo sapiens
tgcccacctctctcc

SEQ ID NO: 78864 - DNA, 15 bp, Homo sapiens
gcccacctctctcct

SEQ ID NO: 78865 - DNA, 15 bp, Homo sapiens
cccacctctctcctg

SEQ ID NO: 78866 - DNA, 15 bp, Homo sapiens
ccacctctctcctgg

SEQ ID NO: 78867 - DNA, 15 bp, Homo sapiens
cacctctctcctggc

SEQ ID NO: 78868 - DNA, 15 bp, Homo sapiens
acctctctcctggcc

SEQ ID NO: 78869 - DNA, 15 bp, Homo sapiens
cctctctcctggcct

SEQ ID NO: 78870 - DNA, 15 bp, Homo sapiens
ctctctcctggcctc

SEQ ID NO: 78871 - DNA, 15 bp, Homo sapiens
tctctcctggcctca

SEQ ID NO: 78872 - DNA, 15 bp, Homo sapiens
ctctcctggcctcag

SEQ ID NO: 78873 - DNA, 15 bp, Homo sapiens
tctcctggcctcagc

SEQ ID NO: 78874 - DNA, 15 bp, Homo sapiens
ctcctggcctcagcg

SEQ ID NO: 78875 - DNA, 15 bp, Homo sapiens
tcctggcctcagcga

SEQ ID NO: 78876 - DNA, 15 bp, Homo sapiens
cctggcctcagcgac

SEQ ID NO: 78877 - DNA, 15 bp, Homo sapiens
ctggcctcagcgact

SEQ ID NO: 78878 - DNA, 15 bp, Homo sapiens
tggcctcagcgactg

SEQ ID NO: 78879 - DNA, 15 bp, Homo sapiens
ggcctcagcgactgg

SEQ ID NO: 78880 - DNA, 15 bp, Homo sapiens
gcctcagcgactgga

SEQ ID NO: 78881 - DNA, 15 bp, Homo sapiens
cctcagcgactggac

SEQ ID NO: 78882 - DNA, 15 bp, Homo sapiens
ctcagcgactggaca

SEQ ID NO: 78883 - DNA, 15 bp, Homo sapiens
tcagcgactggacat

SEQ ID NO: 78884 - DNA, 15 bp, Homo sapiens
cagcgactggacatc

SEQ ID NO: 78885 - DNA, 15 bp, Homo sapiens
agcgactggacatcc

SEQ ID NO: 78886 - DNA, 15 bp, Homo sapiens
gcgactggacatcct

SEQ ID NO: 78887 - DNA, 15 bp, Homo sapiens
cgactggacatcctt

SEQ ID NO: 78888 - DNA, 15 bp, Homo sapiens
gactggacatccttc

SEQ ID NO: 78889 - DNA, 15 bp, Homo sapiens
actggacatccttct

SEQ ID NO: 78890 - DNA, 15 bp, Homo sapiens
ctggacatccttctg

SEQ ID NO: 78891 - DNA, 15 bp, Homo sapiens
tggacatccttctgg

SEQ ID NO: 78892 - DNA, 15 bp, Homo sapiens
ggacatccttctggg

SEQ ID NO: 78893 - DNA, 15 bp, Homo sapiens
gacatccttctgggt

SEQ ID NO: 78894 - DNA, 15 bp, Homo sapiens
acatccttctgggta

SEQ ID NO: 78895 - DNA, 15 bp, Homo sapiens
catccttctgggtac

SEQ ID NO: 78896 - DNA, 15 bp, Homo sapiens
atccttctgggtaca

SEQ ID NO: 78897 - DNA, 15 bp, Homo sapiens
tccttctgggtacag

SEQ ID NO: 78898 - DNA, 15 bp, Homo sapiens
ccttctgggtacagc

SEQ ID NO: 78899 - DNA, 15 bp, Homo sapiens
cttctgggtacagcc

SEQ ID NO: 78900 - DNA, 15 bp, Homo sapiens
ttctgggtacagccc

SEQ ID NO: 78901 - DNA, 15 bp, Homo sapiens
tctgggtacagcccg

SEQ ID NO: 78902 - DNA, 15 bp, Homo sapiens
ctgggtacagcccgg

SEQ ID NO: 78903 - DNA, 15 bp, Homo sapiens
tgggtacagcccggg

SEQ ID NO: 78904 - DNA, 15 bp, Homo sapiens
gggtacagcccgggc

SEQ ID NO: 78905 - DNA, 15 bp, Homo sapiens
ggtacagcccgggca

SEQ ID NO: 78906 - DNA, 15 bp, Homo sapiens
gtacagcccgggcaa

SEQ ID NO: 78907 - DNA, 15 bp, Homo sapiens
tacagcccgggcaat

SEQ ID NO: 78908 - DNA, 15 bp, Homo sapiens
acagcccgggcaatt

SEQ ID NO: 78909 - DNA, 15 bp, Homo sapiens
cagcccgggcaattc

SEQ ID NO: 78910 - DNA, 15 bp, Homo sapiens
agcccgggcaattca

SEQ ID NO: 78911 - DNA, 15 bp, Homo sapiens
gcccgggcaattcag

SEQ ID NO: 78912 - DNA, 15 bp, Homo sapiens
cccgggcaattcagt

SEQ ID NO: 78913 - DNA, 15 bp, Homo sapiens
ccgggcaattcagtt

SEQ ID NO: 78914 - DNA, 15 bp, Homo sapiens
cgggcaattcagttt

SEQ ID NO: 78915 - DNA, 15 bp, Homo sapiens
gggcaattcagtttc

SEQ ID NO: 78916 - DNA, 15 bp, Homo sapiens
ggcaattcagtttct

SEQ ID NO: 78917 - DNA, 15 bp, Homo sapiens
gcaattcagtttcta

SEQ ID NO: 78918 - DNA, 15 bp, Homo sapiens
caattcagtttctac

SEQ ID NO: 78919 - DNA, 15 bp, Homo sapiens
aattcagtttctaca

SEQ ID NO: 78920 - DNA, 15 bp, Homo sapiens
attcagtttctacat

SEQ ID NO: 78921 - DNA, 15 bp, Homo sapiens
ttcagtttctacatc

SEQ ID NO: 78922 - DNA, 15 bp, Homo sapiens
tcagtttctacatca

SEQ ID NO: 78923 - DNA, 15 bp, Homo sapiens
cagtttctacatcag

SEQ ID NO: 78924 - DNA, 15 bp, Homo sapiens
agtttctacatcagg

SEQ ID NO: 78925 - DNA, 15 bp, Homo sapiens
gtttctacatcagga

SEQ ID NO: 78926 - DNA, 15 bp, Homo sapiens
tttctacatcaggac

SEQ ID NO: 78927 - DNA, 15 bp, Homo sapiens
ttctacatcaggaca

SEQ ID NO: 78928 - DNA, 15 bp, Homo sapiens
tctacatcaggacag

SEQ ID NO: 78929 - DNA, 15 bp, Homo sapiens
ctacatcaggacagc

SEQ ID NO: 78930 - DNA, 15 bp, Homo sapiens
tacatcaggacagcc

SEQ ID NO: 78931 - DNA, 15 bp, Homo sapiens
acatcaggacagccc

SEQ ID NO: 78932 - DNA, 15 bp, Homo sapiens
catcaggacagcccc

SEQ ID NO: 78933 - DNA, 15 bp, Homo sapiens
atcaggacagcccca

SEQ ID NO: 78934 - DNA, 15 bp, Homo sapiens
tcaggacagccccag

SEQ ID NO: 78935 - DNA, 15 bp, Homo sapiens
caggacagccccagc

SEQ ID NO: 78936 - DNA, 15 bp, Homo sapiens
aggacagccccagcc

SEQ ID NO: 78937 - DNA, 15 bp, Homo sapiens
ggacagccccagcct

SEQ ID NO: 78938 - DNA, 15 bp, Homo sapiens
gacagccccagcctc

SEQ ID NO: 78939 - DNA, 15 bp, Homo sapiens
acagccccagcctca

SEQ ID NO: 78940 - DNA, 15 bp, Homo sapiens
cagccccagcctcat

SEQ ID NO: 78941 - DNA, 15 bp, Homo sapiens
agccccagcctcatc

SEQ ID NO: 78942 - DNA, 15 bp, Homo sapiens
gccccagcctcatcc

SEQ ID NO: 78943 - DNA, 15 bp, Homo sapiens
ccccagcctcatcca

SEQ ID NO: 78944 - DNA, 15 bp, Homo sapiens
cccagcctcatccat

SEQ ID NO: 78945 - DNA, 15 bp, Homo sapiens
ccagcctcatccatg

SEQ ID NO: 78946 - DNA, 15 bp, Homo sapiens
cagcctcatccatgg

SEQ ID NO: 78947 - DNA, 15 bp, Homo sapiens
agcctcatccatgga

SEQ ID NO: 78948 - DNA, 15 bp, Homo sapiens
gcctcatccatggag

SEQ ID NO: 78949 - DNA, 15 bp, Homo sapiens
cctcatccatggaga

SEQ ID NO: 78950 - DNA, 15 bp, Homo sapiens
ctcatccatggagac

SEQ ID NO: 78951 - DNA, 15 bp, Homo sapiens
tcatccatggagaca

SEQ ID NO: 78952 - DNA, 15 bp, Homo sapiens
catccatggagacat

SEQ ID NO: 78953 - DNA, 15 bp, Homo sapiens
atccatggagacatc

SEQ ID NO: 78954 - DNA, 15 bp, Homo sapiens
tccatggagacatca

SEQ ID NO: 78955 - DNA, 15 bp, Homo sapiens
ccatggagacatcaa

SEQ ID NO: 78956 - DNA, 15 bp, Homo sapiens
catggagacatcaag

SEQ ID NO: 78957 - DNA, 15 bp, Homo sapiens
atggagacatcaaga

SEQ ID NO: 78958 - DNA, 15 bp, Homo sapiens
tggagacatcaagag

SEQ ID NO: 78959 - DNA, 15 bp, Homo sapiens
ggagacatcaagagg

SEQ ID NO: 78960 - DNA, 15 bp, Homo sapiens
gagacatcaagaggt

SEQ ID NO: 78961 - DNA, 15 bp, Homo sapiens
agacatcaagaggtg

SEQ ID NO: 78962 - DNA, 15 bp, Homo sapiens
gacatcaagaggtga

SEQ ID NO: 78963 - DNA, 15 bp, Homo sapiens
acatcaagaggtgag

SEQ ID NO: 78964 - DNA, 15 bp, Homo sapiens
catcaagaggtgagg

SEQ ID NO: 78965 - DNA, 15 bp, Homo sapiens
atcaagaggtgagga

SEQ ID NO: 78966 - DNA, 15 bp, Homo sapiens
tcaagaggtgaggag

SEQ ID NO: 78967 - DNA, 15 bp, Homo sapiens
caagaggtgaggagg

SEQ ID NO: 78968 - DNA, 15 bp, Homo sapiens
aagaggtgaggaggg

SEQ ID NO: 78969 - DNA, 15 bp, Homo sapiens
agaggtgaggagggg

SEQ ID NO: 78970 - DNA, 15 bp, Homo sapiens
gaggtgaggaggggc

SEQ ID NO: 78971 - DNA, 15 bp, Homo sapiens
aggtgaggaggggcc

SEQ ID NO: 78972 - DNA, 15 bp, Homo sapiens
ggtgaggaggggccc

SEQ ID NO: 78973 - DNA, 15 bp, Homo sapiens
gtgaggaggggccct

SEQ ID NO: 78974 - DNA, 15 bp, Homo sapiens
tgaggaggggccctt

SEQ ID NO: 78975 - DNA, 15 bp, Homo sapiens
gaggaggggcccttg

SEQ ID NO: 78976 - DNA, 15 bp, Homo sapiens
aggaggggcccttga

SEQ ID NO: 78977 - DNA, 15 bp, Homo sapiens
ggaggggcccttgag

SEQ ID NO: 78978 - DNA, 15 bp, Homo sapiens
gaggggcccttgaga

SEQ ID NO: 78979 - DNA, 15 bp, Homo sapiens
aggggcccttgagaa

SEQ ID NO: 78980 - DNA, 15 bp, Homo sapiens
ggggcccttgagaac

SEQ ID NO: 78981 - DNA, 15 bp, Homo sapiens
gggcccttgagaact

SEQ ID NO: 78982 - DNA, 15 bp, Homo sapiens
ggcccttgagaactg

SEQ ID NO: 78983 - DNA, 15 bp, Homo sapiens
gcccttgagaactgc

SEQ ID NO: 78984 - DNA, 15 bp, Homo sapiens
cccttgagaactgcc

SEQ ID NO: 78985 - DNA, 15 bp, Homo sapiens
ccttgagaactgccg

SEQ ID NO: 78986 - DNA, 15 bp, Homo sapiens
cttgagaactgccgg

SEQ ID NO: 78987 - DNA, 15 bp, Homo sapiens
ttgagaactgccggg

SEQ ID NO: 78988 - DNA, 15 bp, Homo sapiens
tgagaactgccgggg

SEQ ID NO: 78989 - DNA, 15 bp, Homo sapiens
gagaactgccggggc

SEQ ID NO: 78990 - DNA, 15 bp, Homo sapiens
agaactgccggggca

SEQ ID NO: 78991 - DNA, 15 bp, Homo sapiens
gaactgccggggcag

SEQ ID NO: 78992 - DNA, 15 bp, Homo sapiens
aactgccggggcagg

SEQ ID NO: 78993 - DNA, 15 bp, Homo sapiens
actgccggggcaggg

SEQ ID NO: 78994 - DNA, 15 bp, Homo sapiens
ctgccggggcagggc

SEQ ID NO: 78995 - DNA, 15 bp, Homo sapiens
tgccggggcagggcc

SEQ ID NO: 78996 - DNA, 15 bp, Homo sapiens
gccggggcagggcct

SEQ ID NO: 78997 - DNA, 15 bp, Homo sapiens
ccggggcagggcctg

SEQ ID NO: 78998 - DNA, 15 bp, Homo sapiens
cggggcagggcctgc

SEQ ID NO: 78999 - DNA, 15 bp, Homo sapiens
ggggcagggcctgca

SEQ ID NO: 79000 - DNA, 15 bp, Homo sapiens
gggcagggcctgcag

SEQ ID NO: 79001 - DNA, 15 bp, Homo sapiens
ggcagggcctgcagc

SEQ ID NO: 79002 - DNA, 15 bp, Homo sapiens
gcagggcctgcagca

SEQ ID NO: 79003 - DNA, 15 bp, Homo sapiens
cagggcctgcagcaa

SEQ ID NO: 79004 - DNA, 15 bp, Homo sapiens
agggcctgcagcaag

SEQ ID NO: 79005 - DNA, 15 bp, Homo sapiens
gggcctgcagcaagg

SEQ ID NO: 79006 - DNA, 15 bp, Homo sapiens
ggcctgcagcaaggg

SEQ ID NO: 79007 - DNA, 15 bp, Homo sapiens
gcctgcagcaagggg

SEQ ID NO: 79008 - DNA, 15 bp, Homo sapiens
cctgcagcaaggggg

SEQ ID NO: 79009 - DNA, 15 bp, Homo sapiens
ctgcagcaagggggg

SEQ ID NO: 79010 - DNA, 15 bp, Homo sapiens
tgcagcaaggggggc

SEQ ID NO: 79011 - DNA, 15 bp, Homo sapiens
gcagcaaggggggcc

SEQ ID NO: 79012 - DNA, 15 bp, Homo sapiens
cagcaaggggggccc

SEQ ID NO: 79013 - DNA, 15 bp, Homo sapiens
agcaaggggggcccc

SEQ ID NO: 79014 - DNA, 15 bp, Homo sapiens
gcaaggggggccccg

SEQ ID NO: 79015 - DNA, 15 bp, Homo sapiens
caaggggggccccgc

SEQ ID NO: 79016 - DNA, 15 bp, Homo sapiens
aaggggggccccgcg

SEQ ID NO: 79017 - DNA, 15 bp, Homo sapiens
aggggggccccgcgt

SEQ ID NO: 79018 - DNA, 15 bp, Homo sapiens
ggggggccccgcgtc

SEQ ID NO: 79019 - DNA, 15 bp, Homo sapiens
gggggccccgcgtcc

SEQ ID NO: 79020 - DNA, 15 bp, Homo sapiens
ggggccccgcgtcct

SEQ ID NO: 79021 - DNA, 15 bp, Homo sapiens
gggccccgcgtccta

SEQ ID NO: 79022 - DNA, 15 bp, Homo sapiens
ggccccgcgtcctat

SEQ ID NO: 79023 - DNA, 15 bp, Homo sapiens
gccccgcgtcctatc

SEQ ID NO: 79024 - DNA, 15 bp, Homo sapiens
ccccgcgtcctatca

SEQ ID NO: 79025 - DNA, 15 bp, Homo sapiens
cccgcgtcctatcaa

SEQ ID NO: 79026 - DNA, 15 bp, Homo sapiens
ccgcgtcctatcaat

SEQ ID NO: 79027 - DNA, 15 bp, Homo sapiens
cgcgtcctatcaatg

SEQ ID NO: 79028 - DNA, 15 bp, Homo sapiens
gcgtcctatcaatgt

SEQ ID NO: 79029 - DNA, 15 bp, Homo sapiens
cgtcctatcaatgtg

SEQ ID NO: 79030 - DNA, 15 bp, Homo sapiens
gtcctatcaatgtgg

SEQ ID NO: 79031 - DNA, 15 bp, Homo sapiens
tcctatcaatgtggg

SEQ ID NO: 79032 - DNA, 15 bp, Homo sapiens
cctatcaatgtgggg

SEQ ID NO: 79033 - DNA, 15 bp, Homo sapiens
ctatcaatgtgggga

SEQ ID NO: 79034 - DNA, 15 bp, Homo sapiens
tatcaatgtggggat

SEQ ID NO: 79035 - DNA, 15 bp, Homo sapiens
atcaatgtggggatc

SEQ ID NO: 79036 - DNA, 15 bp, Homo sapiens
tcaatgtggggatca

SEQ ID NO: 79037 - DNA, 15 bp, Homo sapiens
caatgtggggatcag

SEQ ID NO: 79038 - DNA, 15 bp, Homo sapiens
aatgtggggatcagg

SEQ ID NO: 79039 - DNA, 15 bp, Homo sapiens
atgtggggatcaggc

SEQ ID NO: 79040 - DNA, 15 bp, Homo sapiens
tgtggggatcaggca

SEQ ID NO: 79041 - DNA, 15 bp, Homo sapiens
gtggggatcaggcat

SEQ ID NO: 79042 - DNA, 15 bp, Homo sapiens
tggggatcaggcatg

SEQ ID NO: 79043 - DNA, 15 bp, Homo sapiens
ggggatcaggcatgg

SEQ ID NO: 79044 - DNA, 15 bp, Homo sapiens
gggatcaggcatggc

SEQ ID NO: 79045 - DNA, 15 bp, Homo sapiens
ggatcaggcatggcc

SEQ ID NO: 79046 - DNA, 15 bp, Homo sapiens
gatcaggcatggcct

SEQ ID NO: 79047 - DNA, 15 bp, Homo sapiens
atcaggcatggcctg

SEQ ID NO: 79048 - DNA, 15 bp, Homo sapiens
tcaggcatggcctgg

SEQ ID NO: 79049 - DNA, 15 bp, Homo sapiens
caggcatggcctggg

SEQ ID NO: 79050 - DNA, 15 bp, Homo sapiens
aggcatggcctggga

SEQ ID NO: 79051 - DNA, 15 bp, Homo sapiens
ggcatggcctgggac

SEQ ID NO: 79052 - DNA, 15 bp, Homo sapiens
gcatggcctgggacc

SEQ ID NO: 79053 - DNA, 15 bp, Homo sapiens
catggcctgggacct

SEQ ID NO: 79054 - DNA, 15 bp, Homo sapiens
atggcctgggacctc

SEQ ID NO: 79055 - DNA, 15 bp, Homo sapiens
tggcctgggacctca

SEQ ID NO: 79056 - DNA, 15 bp, Homo sapiens
ggcctgggacctcaa

SEQ ID NO: 79057 - DNA, 15 bp, Homo sapiens
gcctgggacctcaac

SEQ ID NO: 79058 - DNA, 15 bp, Homo sapiens
cctgggacctcaaca

SEQ ID NO: 79059 - DNA, 15 bp, Homo sapiens
ctgggacctcaacac

SEQ ID NO: 79060 - DNA, 15 bp, Homo sapiens
tgggacctcaacacc

SEQ ID NO: 79061 - DNA, 15 bp, Homo sapiens
gggacctcaacaccc

SEQ ID NO: 79062 - DNA, 15 bp, Homo sapiens
ggacctcaacacccc

SEQ ID NO: 79063 - DNA, 15 bp, Homo sapiens
gacctcaacaccccg

SEQ ID NO: 79064 - DNA, 15 bp, Homo sapiens
acctcaacaccccgg

SEQ ID NO: 79065 - DNA, 15 bp, Homo sapiens
cctcaacaccccggc

SEQ ID NO: 79066 - DNA, 15 bp, Homo sapiens
ctcaacaccccggca

SEQ ID NO: 79067 - DNA, 15 bp, Homo sapiens
tcaacaccccggcat

SEQ ID NO: 79068 - DNA, 15 bp, Homo sapiens
caacaccccggcatc

SEQ ID NO: 79069 - DNA, 15 bp, Homo sapiens
aacaccccggcatcg

SEQ ID NO: 79070 - DNA, 15 bp, Homo sapiens
acaccccggcatcgc

SEQ ID NO: 79071 - DNA, 15 bp, Homo sapiens
caccccggcatcgca

SEQ ID NO: 79072 - DNA, 15 bp, Homo sapiens
accccggcatcgcac

SEQ ID NO: 79073 - DNA, 15 bp, Homo sapiens
ccccggcatcgcaca

SEQ ID NO: 79074 - DNA, 15 bp, Homo sapiens
cccggcatcgcacag

SEQ ID NO: 79075 - DNA, 15 bp, Homo sapiens
ccggcatcgcacagg

SEQ ID NO: 79076 - DNA, 15 bp, Homo sapiens
cggcatcgcacaggt

SEQ ID NO: 79077 - DNA, 15 bp, Homo sapiens
ggcatcgcacaggtg

SEQ ID NO: 79078 - DNA, 15 bp, Homo sapiens
gcatcgcacaggtgt

SEQ ID NO: 79079 - DNA, 15 bp, Homo sapiens
catcgcacaggtgtg

SEQ ID NO: 79080 - DNA, 15 bp, Homo sapiens
atcgcacaggtgtgg

SEQ ID NO: 79081 - DNA, 15 bp, Homo sapiens
tcgcacaggtgtggg

SEQ ID NO: 79082 - DNA, 15 bp, Homo sapiens
cgcacaggtgtggga

SEQ ID NO: 79083 - DNA, 15 bp, Homo sapiens
gcacaggtgtgggaa

SEQ ID NO: 79084 - DNA, 15 bp, Homo sapiens
cacaggtgtgggaac

SEQ ID NO: 79085 - DNA, 15 bp, Homo sapiens
acaggtgtgggaacg

SEQ ID NO: 79086 - DNA, 15 bp, Homo sapiens
caggtgtgggaacgg

SEQ ID NO: 79087 - DNA, 15 bp, Homo sapiens
aggtgtgggaacggg

SEQ ID NO: 79088 - DNA, 15 bp, Homo sapiens
ggtgtgggaacgggc

SEQ ID NO: 79089 - DNA, 15 bp, Homo sapiens
gtgtgggaacgggcc

SEQ ID NO: 79090 - DNA, 15 bp, Homo sapiens
tgtgggaacgggcca

SEQ ID NO: 79091 - DNA, 15 bp, Homo sapiens
gtgggaacgggccaa

SEQ ID NO: 79092 - DNA, 15 bp, Homo sapiens
tgggaacgggccaag

SEQ ID NO: 79093 - DNA, 15 bp, Homo sapiens
gggaacgggccaagg

SEQ ID NO: 79094 - DNA, 15 bp, Homo sapiens
ggaacgggccaagga

SEQ ID NO: 79095 - DNA, 15 bp, Homo sapiens
gaacgggccaaggat

SEQ ID NO: 79096 - DNA, 15 bp, Homo sapiens
aacgggccaaggatg

SEQ ID NO: 79097 - DNA, 15 bp, Homo sapiens
acgggccaaggatgg

SEQ ID NO: 79098 - DNA, 15 bp, Homo sapiens
cgggccaaggatggg

SEQ ID NO: 79099 - DNA, 15 bp, Homo sapiens
gggccaaggatgggc

SEQ ID NO: 79100 - DNA, 15 bp, Homo sapiens
ggccaaggatgggcc

SEQ ID NO: 79101 - DNA, 15 bp, Homo sapiens
gccaaggatgggccc

SEQ ID NO: 79102 - DNA, 15 bp, Homo sapiens
ccaaggatgggccct

SEQ ID NO: 79103 - DNA, 15 bp, Homo sapiens
caaggatgggcccta

SEQ ID NO: 79104 - DNA, 15 bp, Homo sapiens
aaggatgggccctac

SEQ ID NO: 79105 - DNA, 15 bp, Homo sapiens
aggatgggccctact

SEQ ID NO: 79106 - DNA, 15 bp, Homo sapiens
ggatgggccctactg

SEQ ID NO: 79107 - DNA, 15 bp, Homo sapiens
gatgggccctactga

SEQ ID NO: 79108 - DNA, 15 bp, Homo sapiens
atgggccctactgat

SEQ ID NO: 79109 - DNA, 15 bp, Homo sapiens
tgggccctactgatg

SEQ ID NO: 79110 - DNA, 15 bp, Homo sapiens
gggccctactgatga

SEQ ID NO: 79111 - DNA, 15 bp, Homo sapiens
ggccctactgatgag

SEQ ID NO: 79112 - DNA, 15 bp, Homo sapiens
gccctactgatgagc

SEQ ID NO: 79113 - DNA, 15 bp, Homo sapiens
ccctactgatgagca

SEQ ID NO: 79114 - DNA, 15 bp, Homo sapiens
cctactgatgagcag

SEQ ID NO: 79115 - DNA, 15 bp, Homo sapiens
ctactgatgagcaga

SEQ ID NO: 79116 - DNA, 15 bp, Homo sapiens
tactgatgagcagag

SEQ ID NO: 79117 - DNA, 15 bp, Homo sapiens
actgatgagcagagg

SEQ ID NO: 79118 - DNA, 15 bp, Homo sapiens
ctgatgagcagaggc

SEQ ID NO: 79119 - DNA, 15 bp, Homo sapiens
tgatgagcagaggcc

SEQ ID NO: 79120 - DNA, 15 bp, Homo sapiens
gatgagcagaggccc

SEQ ID NO: 79121 - DNA, 15 bp, Homo sapiens
atgagcagaggcccc

SEQ ID NO: 79122 - DNA, 15 bp, Homo sapiens
tgagcagaggccccc

SEQ ID NO: 79123 - DNA, 15 bp, Homo sapiens
gagcagaggccccca

SEQ ID NO: 79124 - DNA, 15 bp, Homo sapiens
agcagaggcccccag

SEQ ID NO: 79125 - DNA, 15 bp, Homo sapiens
gcagaggcccccagg

SEQ ID NO: 79126 - DNA, 15 bp, Homo sapiens
cagaggcccccaggc

SEQ ID NO: 79127 - DNA, 15 bp, Homo sapiens
agaggcccccaggca

SEQ ID NO: 79128 - DNA, 15 bp, Homo sapiens
gaggcccccaggcag

SEQ ID NO: 79129 - DNA, 15 bp, Homo sapiens
aggcccccaggcagc

SEQ ID NO: 79130 - DNA, 15 bp, Homo sapiens
ggcccccaggcagct

SEQ ID NO: 79131 - DNA, 15 bp, Homo sapiens
gcccccaggcagctg

SEQ ID NO: 79132 - DNA, 15 bp, Homo sapiens
cccccaggcagctgg

SEQ ID NO: 79133 - DNA, 15 bp, Homo sapiens
ccccaggcagctgga

SEQ ID NO: 79134 - DNA, 15 bp, Homo sapiens
cccaggcagctggag

SEQ ID NO: 79135 - DNA, 15 bp, Homo sapiens
ccaggcagctggagc

SEQ ID NO: 79136 - DNA, 15 bp, Homo sapiens
caggcagctggagcg

SEQ ID NO: 79137 - DNA, 15 bp, Homo sapiens
aggcagctggagcgc

SEQ ID NO: 79138 - DNA, 15 bp, Homo sapiens
ggcagctggagcgct

SEQ ID NO: 79139 - DNA, 15 bp, Homo sapiens
gcagctggagcgctc

SEQ ID NO: 79140 - DNA, 15 bp, Homo sapiens
cagctggagcgctca

SEQ ID NO: 79141 - DNA, 15 bp, Homo sapiens
agctggagcgctcag

SEQ ID NO: 79142 - DNA, 15 bp, Homo sapiens
gctggagcgctcagg

SEQ ID NO: 79143 - DNA, 15 bp, Homo sapiens
ctggagcgctcaggg

SEQ ID NO: 79144 - DNA, 15 bp, Homo sapiens
tggagcgctcagggc

SEQ ID NO: 79145 - DNA, 15 bp, Homo sapiens
ggagcgctcagggca

SEQ ID NO: 79146 - DNA, 15 bp, Homo sapiens
gagcgctcagggcag

SEQ ID NO: 79147 - DNA, 15 bp, Homo sapiens
agcgctcagggcagt

SEQ ID NO: 79148 - DNA, 15 bp, Homo sapiens
gcgctcagggcagtg

SEQ ID NO: 79149 - DNA, 15 bp, Homo sapiens
cgctcagggcagtgc

SEQ ID NO: 79150 - DNA, 15 bp, Homo sapiens
gctcagggcagtgcc

SEQ ID NO: 79151 - DNA, 15 bp, Homo sapiens
ctcagggcagtgcca

SEQ ID NO: 79152 - DNA, 15 bp, Homo sapiens
tcagggcagtgccag

SEQ ID NO: 79153 - DNA, 15 bp, Homo sapiens
cagggcagtgccagc

SEQ ID NO: 79154 - DNA, 15 bp, Homo sapiens
agggcagtgccagcg

SEQ ID NO: 79155 - DNA, 15 bp, Homo sapiens
gggcagtgccagcgc

SEQ ID NO: 79156 - DNA, 15 bp, Homo sapiens
ggcagtgccagcgct

SEQ ID NO: 79157 - DNA, 15 bp, Homo sapiens
gcagtgccagcgctt

SEQ ID NO: 79158 - DNA, 15 bp, Homo sapiens
cagtgccagcgcttt

SEQ ID NO: 79159 - DNA, 15 bp, Homo sapiens
agtgccagcgctttc

SEQ ID NO: 79160 - DNA, 15 bp, Homo sapiens
gtgccagcgctttct

SEQ ID NO: 79161 - DNA, 15 bp, Homo sapiens
tgccagcgctttctg

SEQ ID NO: 79162 - DNA, 15 bp, Homo sapiens
gccagcgctttctgt

SEQ ID NO: 79163 - DNA, 15 bp, Homo sapiens
ccagcgctttctgtg

SEQ ID NO: 79164 - DNA, 15 bp, Homo sapiens
cagcgctttctgtgg

SEQ ID NO: 79165 - DNA, 15 bp, Homo sapiens
agcgctttctgtggg

SEQ ID NO: 79166 - DNA, 15 bp, Homo sapiens
gcgctttctgtgggc

SEQ ID NO: 79167 - DNA, 15 bp, Homo sapiens
cgctttctgtgggca

SEQ ID NO: 79168 - DNA, 15 bp, Homo sapiens
gctttctgtgggcaa

SEQ ID NO: 79169 - DNA, 15 bp, Homo sapiens
ctttctgtgggcaag

SEQ ID NO: 79170 - DNA, 15 bp, Homo sapiens
tttctgtgggcaagg

SEQ ID NO: 79171 - DNA, 15 bp, Homo sapiens
ttctgtgggcaaggc

SEQ ID NO: 79172 - DNA, 15 bp, Homo sapiens
tctgtgggcaaggca

SEQ ID NO: 79173 - DNA, 15 bp, Homo sapiens
ctgtgggcaaggcac

SEQ ID NO: 79174 - DNA, 15 bp, Homo sapiens
tgtgggcaaggcacc

SEQ ID NO: 79175 - DNA, 15 bp, Homo sapiens
gtgggcaaggcaccg

SEQ ID NO: 79176 - DNA, 15 bp, Homo sapiens
tgggcaaggcaccgg

SEQ ID NO: 79177 - DNA, 15 bp, Homo sapiens
gggcaaggcaccggg

SEQ ID NO: 79178 - DNA, 15 bp, Homo sapiens
ggcaaggcaccgggc

SEQ ID NO: 79179 - DNA, 15 bp, Homo sapiens
gcaaggcaccgggct

SEQ ID NO: 79180 - DNA, 15 bp, Homo sapiens
caaggcaccgggctg

SEQ ID NO: 79181 - DNA, 15 bp, Homo sapiens
aaggcaccgggctgg

SEQ ID NO: 79182 - DNA, 15 bp, Homo sapiens
aggcaccgggctggc

SEQ ID NO: 79183 - DNA, 15 bp, Homo sapiens
ggcaccgggctggca

SEQ ID NO: 79184 - DNA, 15 bp, Homo sapiens
gcaccgggctggcag

SEQ ID NO: 79185 - DNA, 15 bp, Homo sapiens
caccgggctggcagc

SEQ ID NO: 79186 - DNA, 15 bp, Homo sapiens
accgggctggcagcc

SEQ ID NO: 79187 - DNA, 15 bp, Homo sapiens
ccgggctggcagcct

SEQ ID NO: 79188 - DNA, 15 bp, Homo sapiens
cgggctggcagcctc

SEQ ID NO: 79189 - DNA, 15 bp, Homo sapiens
gggctggcagcctcg

SEQ ID NO: 79190 - DNA, 15 bp, Homo sapiens
ggctggcagcctcga

SEQ ID NO: 79191 - DNA, 15 bp, Homo sapiens
gctggcagcctcgag

SEQ ID NO: 79192 - DNA, 15 bp, Homo sapiens
ctggcagcctcgagt

SEQ ID NO: 79193 - DNA, 15 bp, Homo sapiens
tggcagcctcgagtc

SEQ ID NO: 79194 - DNA, 15 bp, Homo sapiens
ggcagcctcgagtcc

SEQ ID NO: 79195 - DNA, 15 bp, Homo sapiens
gcagcctcgagtcca

SEQ ID NO: 79196 - DNA, 15 bp, Homo sapiens
cagcctcgagtccag

SEQ ID NO: 79197 - DNA, 15 bp, Homo sapiens
agcctcgagtccagc

SEQ ID NO: 79198 - DNA, 15 bp, Homo sapiens
gcctcgagtccagcc

SEQ ID NO: 79199 - DNA, 15 bp, Homo sapiens
cctcgagtccagcct

SEQ ID NO: 79200 - DNA, 15 bp, Homo sapiens
ctcgagtccagcctt

SEQ ID NO: 79201 - DNA, 15 bp, Homo sapiens
tcgagtccagcctta

SEQ ID NO: 79202 - DNA, 15 bp, Homo sapiens
cgagtccagccttat

SEQ ID NO: 79203 - DNA, 15 bp, Homo sapiens
gagtccagccttatc

SEQ ID NO: 79204 - DNA, 15 bp, Homo sapiens
agtccagccttatct

SEQ ID NO: 79205 - DNA, 15 bp, Homo sapiens
gtccagccttatcta

SEQ ID NO: 79206 - DNA, 15 bp, Homo sapiens
tccagccttatctaa

SEQ ID NO: 79207 - DNA, 15 bp, Homo sapiens
ccagccttatctaag

SEQ ID NO: 79208 - DNA, 15 bp, Homo sapiens
cagccttatctaagc

SEQ ID NO: 79209 - DNA, 15 bp, Homo sapiens
agccttatctaagcc

SEQ ID NO: 79210 - DNA, 15 bp, Homo sapiens
gccttatctaagccg

SEQ ID NO: 79211 - DNA, 15 bp, Homo sapiens
ccttatctaagccgg

SEQ ID NO: 79212 - DNA, 15 bp, Homo sapiens
cttatctaagccggg

SEQ ID NO: 79213 - DNA, 15 bp, Homo sapiens
ttatctaagccgggc

SEQ ID NO: 79214 - DNA, 15 bp, Homo sapiens
tatctaagccgggca

SEQ ID NO: 79215 - DNA, 15 bp, Homo sapiens
atctaagccgggcag

SEQ ID NO: 79216 - DNA, 15 bp, Homo sapiens
tctaagccgggcagg

SEQ ID NO: 79217 - DNA, 15 bp, Homo sapiens
ctaagccgggcaggt

SEQ ID NO: 79218 - DNA, 15 bp, Homo sapiens
taagccgggcaggtg

SEQ ID NO: 79219 - DNA, 15 bp, Homo sapiens
aagccgggcaggtgt

SEQ ID NO: 79220 - DNA, 15 bp, Homo sapiens
agccgggcaggtgta

SEQ ID NO: 79221 - DNA, 15 bp, Homo sapiens
gccgggcaggtgtag

SEQ ID NO: 79222 - DNA, 15 bp, Homo sapiens
ccgggcaggtgtagg

SEQ ID NO: 79223 - DNA, 15 bp, Homo sapiens
cgggcaggtgtagga

SEQ ID NO: 79224 - DNA, 15 bp, Homo sapiens
gggcaggtgtaggag

SEQ ID NO: 79225 - DNA, 15 bp, Homo sapiens
ggcaggtgtaggagc

SEQ ID NO: 79226 - DNA, 15 bp, Homo sapiens
gcaggtgtaggagct

SEQ ID NO: 79227 - DNA, 15 bp, Homo sapiens
caggtgtaggagcta

SEQ ID NO: 79228 - DNA, 15 bp, Homo sapiens
aggtgtaggagctag

SEQ ID NO: 79229 - DNA, 15 bp, Homo sapiens
ggtgtaggagctagg

SEQ ID NO: 79230 - DNA, 15 bp, Homo sapiens
gtgtaggagctagga

SEQ ID NO: 79231 - DNA, 15 bp, Homo sapiens
tgtaggagctaggac

SEQ ID NO: 79232 - DNA, 15 bp, Homo sapiens
gtaggagctaggacc

SEQ ID NO: 79233 - DNA, 15 bp, Homo sapiens
taggagctaggaccg

SEQ ID NO: 79234 - DNA, 15 bp, Homo sapiens
aggagctaggaccgg

SEQ ID NO: 79235 - DNA, 15 bp, Homo sapiens
ggagctaggaccggg

SEQ ID NO: 79236 - DNA, 15 bp, Homo sapiens
gagctaggaccgggc

SEQ ID NO: 79237 - DNA, 15 bp, Homo sapiens
agctaggaccgggct

SEQ ID NO: 79238 - DNA, 15 bp, Homo sapiens
gctaggaccgggctg

SEQ ID NO: 79239 - DNA, 15 bp, Homo sapiens
ctaggaccgggctga

SEQ ID NO: 79240 - DNA, 15 bp, Homo sapiens
taggaccgggctgac

SEQ ID NO: 79241 - DNA, 15 bp, Homo sapiens
aggaccgggctgacg

SEQ ID NO: 79242 - DNA, 15 bp, Homo sapiens
ggaccgggctgacgc

SEQ ID NO: 79243 - DNA, 15 bp, Homo sapiens
gaccgggctgacgcc

SEQ ID NO: 79244 - DNA, 15 bp, Homo sapiens
accgggctgacgcca

SEQ ID NO: 79245 - DNA, 15 bp, Homo sapiens
ccgggctgacgccac

SEQ ID NO: 79246 - DNA, 15 bp, Homo sapiens
cgggctgacgccact

SEQ ID NO: 79247 - DNA, 15 bp, Homo sapiens
gggctgacgccactg

SEQ ID NO: 79248 - DNA, 15 bp, Homo sapiens
ggctgacgccactgt

SEQ ID NO: 79249 - DNA, 15 bp, Homo sapiens
gctgacgccactgtc

SEQ ID NO: 79250 - DNA, 15 bp, Homo sapiens
ctgacgccactgtct

SEQ ID NO: 79251 - DNA, 15 bp, Homo sapiens
tgacgccactgtctt

SEQ ID NO: 79252 - DNA, 15 bp, Homo sapiens
gacgccactgtcttc

SEQ ID NO: 79253 - DNA, 15 bp, Homo sapiens
acgccactgtcttct

SEQ ID NO: 79254 - DNA, 15 bp, Homo sapiens
cgccactgtcttctc

SEQ ID NO: 79255 - DNA, 15 bp, Homo sapiens
gccactgtcttctct

SEQ ID NO: 79256 - DNA, 15 bp, Homo sapiens
ccactgtcttctctc

SEQ ID NO: 79257 - DNA, 15 bp, Homo sapiens
cactgtcttctctcc

SEQ ID NO: 79258 - DNA, 15 bp, Homo sapiens
actgtcttctctccc

SEQ ID NO: 79259 - DNA, 15 bp, Homo sapiens
ctgtcttctctcccc

SEQ ID NO: 79260 - DNA, 15 bp, Homo sapiens
tgtcttctctcccca

SEQ ID NO: 79261 - DNA, 15 bp, Homo sapiens
gtcttctctccccaa

SEQ ID NO: 79262 - DNA, 15 bp, Homo sapiens
tcttctctccccaag

SEQ ID NO: 79263 - DNA, 15 bp, Homo sapiens
cttctctccccaagt

SEQ ID NO: 79264 - DNA, 15 bp, Homo sapiens
ttctctccccaagtt

SEQ ID NO: 79265 - DNA, 15 bp, Homo sapiens
tctctccccaagttc

SEQ ID NO: 79266 - DNA, 15 bp, Homo sapiens
ctctccccaagttcc

SEQ ID NO: 79267 - DNA, 15 bp, Homo sapiens
tctccccaagttcca

SEQ ID NO: 79268 - DNA, 15 bp, Homo sapiens
ctccccaagttccaa

SEQ ID NO: 79269 - DNA, 15 bp, Homo sapiens
tccccaagttccaac

SEQ ID NO: 79270 - DNA, 15 bp, Homo sapiens
ccccaagttccaacg

SEQ ID NO: 79271 - DNA, 15 bp, Homo sapiens
cccaagttccaacgt

SEQ ID NO: 79272 - DNA, 15 bp, Homo sapiens
ccaagttccaacgtc

SEQ ID NO: 79273 - DNA, 15 bp, Homo sapiens
caagttccaacgtcc

SEQ ID NO: 79274 - DNA, 15 bp, Homo sapiens
aagttccaacgtcct

SEQ ID NO: 79275 - DNA, 15 bp, Homo sapiens
agttccaacgtcctt

SEQ ID NO: 79276 - DNA, 15 bp, Homo sapiens
gttccaacgtccttc

SEQ ID NO: 79277 - DNA, 15 bp, Homo sapiens
ttccaacgtccttct

SEQ ID NO: 79278 - DNA, 15 bp, Homo sapiens
tccaacgtccttctg

SEQ ID NO: 79279 - DNA, 15 bp, Homo sapiens
ccaacgtccttctgg

SEQ ID NO: 79280 - DNA, 15 bp, Homo sapiens
caacgtccttctgga

SEQ ID NO: 79281 - DNA, 15 bp, Homo sapiens
aacgtccttctggat

SEQ ID NO: 79282 - DNA, 15 bp, Homo sapiens
acgtccttctggatg

SEQ ID NO: 79283 - DNA, 15 bp, Homo sapiens
cgtccttctggatga

SEQ ID NO: 79284 - DNA, 15 bp, Homo sapiens
gtccttctggatgag

SEQ ID NO: 79285 - DNA, 15 bp, Homo sapiens
tccttctggatgaga

SEQ ID NO: 79286 - DNA, 15 bp, Homo sapiens
ccttctggatgagag

SEQ ID NO: 79287 - DNA, 15 bp, Homo sapiens
cttctggatgagagg

SEQ ID NO: 79288 - DNA, 15 bp, Homo sapiens
ttctggatgagaggc

SEQ ID NO: 79289 - DNA, 15 bp, Homo sapiens
tctggatgagaggct

SEQ ID NO: 79290 - DNA, 15 bp, Homo sapiens
ctggatgagaggctg

SEQ ID NO: 79291 - DNA, 15 bp, Homo sapiens
tggatgagaggctga

SEQ ID NO: 79292 - DNA, 15 bp, Homo sapiens
ggatgagaggctgac

SEQ ID NO: 79293 - DNA, 15 bp, Homo sapiens
gatgagaggctgaca

SEQ ID NO: 79294 - DNA, 15 bp, Homo sapiens
atgagaggctgacac

SEQ ID NO: 79295 - DNA, 15 bp, Homo sapiens
tgagaggctgacacc

SEQ ID NO: 79296 - DNA, 15 bp, Homo sapiens
gagaggctgacaccc

SEQ ID NO: 79297 - DNA, 15 bp, Homo sapiens
agaggctgacaccca

SEQ ID NO: 79298 - DNA, 15 bp, Homo sapiens
gaggctgacacccaa

SEQ ID NO: 79299 - DNA, 15 bp, Homo sapiens
aggctgacacccaag

SEQ ID NO: 79300 - DNA, 15 bp, Homo sapiens
ggctgacacccaagc

SEQ ID NO: 79301 - DNA, 15 bp, Homo sapiens
gctgacacccaagct

SEQ ID NO: 79302 - DNA, 15 bp, Homo sapiens
ctgacacccaagctg

SEQ ID NO: 79303 - DNA, 15 bp, Homo sapiens
tgacacccaagctgg

SEQ ID NO: 79304 - DNA, 15 bp, Homo sapiens
gacacccaagctggg

SEQ ID NO: 79305 - DNA, 15 bp, Homo sapiens
acacccaagctggga

SEQ ID NO: 79306 - DNA, 15 bp, Homo sapiens
cacccaagctgggag

SEQ ID NO: 79307 - DNA, 15 bp, Homo sapiens
acccaagctgggaga

SEQ ID NO: 79308 - DNA, 15 bp, Homo sapiens
cccaagctgggagac

SEQ ID NO: 79309 - DNA, 15 bp, Homo sapiens
ccaagctgggagact

SEQ ID NO: 79310 - DNA, 15 bp, Homo sapiens
caagctgggagactt

SEQ ID NO: 79311 - DNA, 15 bp, Homo sapiens
aagctgggagacttt

SEQ ID NO: 79312 - DNA, 15 bp, Homo sapiens
agctgggagactttg

SEQ ID NO: 79313 - DNA, 15 bp, Homo sapiens
gctgggagactttgg

SEQ ID NO: 79314 - DNA, 15 bp, Homo sapiens
ctgggagactttggc

SEQ ID NO: 79315 - DNA, 15 bp, Homo sapiens
tgggagactttggcc

SEQ ID NO: 79316 - DNA, 15 bp, Homo sapiens
gggagactttggcct

SEQ ID NO: 79317 - DNA, 15 bp, Homo sapiens
ggagactttggcctg

SEQ ID NO: 79318 - DNA, 15 bp, Homo sapiens
gagactttggcctgg

SEQ ID NO: 79319 - DNA, 15 bp, Homo sapiens
agactttggcctggc

SEQ ID NO: 79320 - DNA, 15 bp, Homo sapiens
gactttggcctggcc

SEQ ID NO: 79321 - DNA, 15 bp, Homo sapiens
actttggcctggccc

SEQ ID NO: 79322 - DNA, 15 bp, Homo sapiens
ctttggcctggcccg

SEQ ID NO: 79323 - DNA, 15 bp, Homo sapiens
tttggcctggcccgg

SEQ ID NO: 79324 - DNA, 15 bp, Homo sapiens
ttggcctggcccggt

SEQ ID NO: 79325 - DNA, 15 bp, Homo sapiens
tggcctggcccggtt

SEQ ID NO: 79326 - DNA, 15 bp, Homo sapiens
ggcctggcccggttc

SEQ ID NO: 79327 - DNA, 15 bp, Homo sapiens
gcctggcccggttca

SEQ ID NO: 79328 - DNA, 15 bp, Homo sapiens
cctggcccggttcag

SEQ ID NO: 79329 - DNA, 15 bp, Homo sapiens
ctggcccggttcagc

SEQ ID NO: 79330 - DNA, 15 bp, Homo sapiens
tggcccggttcagcc

SEQ ID NO: 79331 - DNA, 15 bp, Homo sapiens
ggcccggttcagccg

SEQ ID NO: 79332 - DNA, 15 bp, Homo sapiens
gcccggttcagccgc

SEQ ID NO: 79333 - DNA, 15 bp, Homo sapiens
cccggttcagccgct

SEQ ID NO: 79334 - DNA, 15 bp, Homo sapiens
ccggttcagccgctt

SEQ ID NO: 79335 - DNA, 15 bp, Homo sapiens
cggttcagccgcttt

SEQ ID NO: 79336 - DNA, 15 bp, Homo sapiens
ggttcagccgctttg

SEQ ID NO: 79337 - DNA, 15 bp, Homo sapiens
gttcagccgctttgc

SEQ ID NO: 79338 - DNA, 15 bp, Homo sapiens
ttcagccgctttgcc

SEQ ID NO: 79339 - DNA, 15 bp, Homo sapiens
tcagccgctttgccg

SEQ ID NO: 79340 - DNA, 15 bp, Homo sapiens
cagccgctttgccgg

SEQ ID NO: 79341 - DNA, 15 bp, Homo sapiens
agccgctttgccggg

SEQ ID NO: 79342 - DNA, 15 bp, Homo sapiens
gccgctttgccgggt

SEQ ID NO: 79343 - DNA, 15 bp, Homo sapiens
ccgctttgccgggtc

SEQ ID NO: 79344 - DNA, 15 bp, Homo sapiens
cgctttgccgggtcc

SEQ ID NO: 79345 - DNA, 15 bp, Homo sapiens
gctttgccgggtcca

SEQ ID NO: 79346 - DNA, 15 bp, Homo sapiens
ctttgccgggtccag

SEQ ID NO: 79347 - DNA, 15 bp, Homo sapiens
tttgccgggtccagc

SEQ ID NO: 79348 - DNA, 15 bp, Homo sapiens
ttgccgggtccagcc

SEQ ID NO: 79349 - DNA, 15 bp, Homo sapiens
tgccgggtccagccc

SEQ ID NO: 79350 - DNA, 15 bp, Homo sapiens
gccgggtccagcccc

SEQ ID NO: 79351 - DNA, 15 bp, Homo sapiens
ccgggtccagcccca

SEQ ID NO: 79352 - DNA, 15 bp, Homo sapiens
cgggtccagccccag

SEQ ID NO: 79353 - DNA, 15 bp, Homo sapiens
gggtccagccccagc

SEQ ID NO: 79354 - DNA, 15 bp, Homo sapiens
ggtccagccccagcc

SEQ ID NO: 79355 - DNA, 15 bp, Homo sapiens
gtccagccccagcca

SEQ ID NO: 79356 - DNA, 15 bp, Homo sapiens
tccagccccagccag

SEQ ID NO: 79357 - DNA, 15 bp, Homo sapiens
ccagccccagccaga

SEQ ID NO: 79358 - DNA, 15 bp, Homo sapiens
cagccccagccagag

SEQ ID NO: 79359 - DNA, 15 bp, Homo sapiens
agccccagccagagc

SEQ ID NO: 79360 - DNA, 15 bp, Homo sapiens
gccccagccagagca

SEQ ID NO: 79361 - DNA, 15 bp, Homo sapiens
ccccagccagagcag

SEQ ID NO: 79362 - DNA, 15 bp, Homo sapiens
cccagccagagcagc

SEQ ID NO: 79363 - DNA, 15 bp, Homo sapiens
ccagccagagcagca

SEQ ID NO: 79364 - DNA, 15 bp, Homo sapiens
cagccagagcagcat

SEQ ID NO: 79365 - DNA, 15 bp, Homo sapiens
agccagagcagcatg

SEQ ID NO: 79366 - DNA, 15 bp, Homo sapiens
gccagagcagcatgg

SEQ ID NO: 79367 - DNA, 15 bp, Homo sapiens
ccagagcagcatggt

SEQ ID NO: 79368 - DNA, 15 bp, Homo sapiens
cagagcagcatggtg

SEQ ID NO: 79369 - DNA, 15 bp, Homo sapiens
agagcagcatggtgg

SEQ ID NO: 79370 - DNA, 15 bp, Homo sapiens
gagcagcatggtggc

SEQ ID NO: 79371 - DNA, 15 bp, Homo sapiens
agcagcatggtggcc

SEQ ID NO: 79372 - DNA, 15 bp, Homo sapiens
gcagcatggtggccc

SEQ ID NO: 79373 - DNA, 15 bp, Homo sapiens
cagcatggtggcccg

SEQ ID NO: 79374 - DNA, 15 bp, Homo sapiens
agcatggtggcccgg

SEQ ID NO: 79375 - DNA, 15 bp, Homo sapiens
gcatggtggcccgga

SEQ ID NO: 79376 - DNA, 15 bp, Homo sapiens
catggtggcccggac

SEQ ID NO: 79377 - DNA, 15 bp, Homo sapiens
atggtggcccggaca

SEQ ID NO: 79378 - DNA, 15 bp, Homo sapiens
tggtggcccggacac

SEQ ID NO: 79379 - DNA, 15 bp, Homo sapiens
ggtggcccggacaca

SEQ ID NO: 79380 - DNA, 15 bp, Homo sapiens
gtggcccggacacag

SEQ ID NO: 79381 - DNA, 15 bp, Homo sapiens
tggcccggacacaga

SEQ ID NO: 79382 - DNA, 15 bp, Homo sapiens
ggcccggacacagac

SEQ ID NO: 79383 - DNA, 15 bp, Homo sapiens
gcccggacacagaca

SEQ ID NO: 79384 - DNA, 15 bp, Homo sapiens
cccggacacagacag

SEQ ID NO: 79385 - DNA, 15 bp, Homo sapiens
ccggacacagacagt

SEQ ID NO: 79386 - DNA, 15 bp, Homo sapiens
cggacacagacagtg

SEQ ID NO: 79387 - DNA, 15 bp, Homo sapiens
ggacacagacagtgc

SEQ ID NO: 79388 - DNA, 15 bp, Homo sapiens
gacacagacagtgcg

SEQ ID NO: 79389 - DNA, 15 bp, Homo sapiens
acacagacagtgcgg

SEQ ID NO: 79390 - DNA, 15 bp, Homo sapiens
cacagacagtgcggg

SEQ ID NO: 79391 - DNA, 15 bp, Homo sapiens
acagacagtgcgggg

SEQ ID NO: 79392 - DNA, 15 bp, Homo sapiens
cagacagtgcggggc

SEQ ID NO: 79393 - DNA, 15 bp, Homo sapiens
agacagtgcggggca

SEQ ID NO: 79394 - DNA, 15 bp, Homo sapiens
gacagtgcggggcac

SEQ ID NO: 79395 - DNA, 15 bp, Homo sapiens
acagtgcggggcacc

SEQ ID NO: 79396 - DNA, 15 bp, Homo sapiens
cagtgcggggcaccc

SEQ ID NO: 79397 - DNA, 15 bp, Homo sapiens
agtgcggggcaccct

SEQ ID NO: 79398 - DNA, 15 bp, Homo sapiens
gtgcggggcaccctg

SEQ ID NO: 79399 - DNA, 15 bp, Homo sapiens
tgcggggcaccctgg

SEQ ID NO: 79400 - DNA, 15 bp, Homo sapiens
gcggggcaccctggc

SEQ ID NO: 79401 - DNA, 15 bp, Homo sapiens
cggggcaccctggcc

SEQ ID NO: 79402 - DNA, 15 bp, Homo sapiens
ggggcaccctggcct

SEQ ID NO: 79403 - DNA, 15 bp, Homo sapiens
gggcaccctggccta

SEQ ID NO: 79404 - DNA, 15 bp, Homo sapiens
ggcaccctggcctac

SEQ ID NO: 79405 - DNA, 15 bp, Homo sapiens
gcaccctggcctacc

SEQ ID NO: 79406 - DNA, 15 bp, Homo sapiens
caccctggcctacct

SEQ ID NO: 79407 - DNA, 15 bp, Homo sapiens
accctggcctacctg

SEQ ID NO: 79408 - DNA, 15 bp, Homo sapiens
ccctggcctacctgc

SEQ ID NO: 79409 - DNA, 15 bp, Homo sapiens
cctggcctacctgcc

SEQ ID NO: 79410 - DNA, 15 bp, Homo sapiens
ctggcctacctgccc

SEQ ID NO: 79411 - DNA, 15 bp, Homo sapiens
tggcctacctgcccg

SEQ ID NO: 79412 - DNA, 15 bp, Homo sapiens
ggcctacctgcccga

SEQ ID NO: 79413 - DNA, 15 bp, Homo sapiens
gcctacctgcccgag

SEQ ID NO: 79414 - DNA, 15 bp, Homo sapiens
cctacctgcccgagg

SEQ ID NO: 79415 - DNA, 15 bp, Homo sapiens
ctacctgcccgagga

SEQ ID NO: 79416 - DNA, 15 bp, Homo sapiens
tacctgcccgaggag

SEQ ID NO: 79417 - DNA, 15 bp, Homo sapiens
acctgcccgaggagt

SEQ ID NO: 79418 - DNA, 15 bp, Homo sapiens
cctgcccgaggagta

SEQ ID NO: 79419 - DNA, 15 bp, Homo sapiens
ctgcccgaggagtac

SEQ ID NO: 79420 - DNA, 15 bp, Homo sapiens
tgcccgaggagtaca

SEQ ID NO: 79421 - DNA, 15 bp, Homo sapiens
gcccgaggagtacat

SEQ ID NO: 79422 - DNA, 15 bp, Homo sapiens
cccgaggagtacatc

SEQ ID NO: 79423 - DNA, 15 bp, Homo sapiens
ccgaggagtacatca

SEQ ID NO: 79424 - DNA, 15 bp, Homo sapiens
cgaggagtacatcaa

SEQ ID NO: 79425 - DNA, 15 bp, Homo sapiens
gaggagtacatcaag

SEQ ID NO: 79426 - DNA, 15 bp, Homo sapiens
aggagtacatcaaga

SEQ ID NO: 79427 - DNA, 15 bp, Homo sapiens
ggagtacatcaagac

SEQ ID NO: 79428 - DNA, 15 bp, Homo sapiens
gagtacatcaagacg

SEQ ID NO: 79429 - DNA, 15 bp, Homo sapiens
agtacatcaagacgg

SEQ ID NO: 79430 - DNA, 15 bp, Homo sapiens
gtacatcaagacggg

SEQ ID NO: 79431 - DNA, 15 bp, Homo sapiens
tacatcaagacggga

SEQ ID NO: 79432 - DNA, 15 bp, Homo sapiens
acatcaagacgggaa

SEQ ID NO: 79433 - DNA, 15 bp, Homo sapiens
catcaagacgggaag

SEQ ID NO: 79434 - DNA, 15 bp, Homo sapiens
atcaagacgggaagg

SEQ ID NO: 79435 - DNA, 15 bp, Homo sapiens
tcaagacgggaaggc

SEQ ID NO: 79436 - DNA, 15 bp, Homo sapiens
caagacgggaaggct

SEQ ID NO: 79437 - DNA, 15 bp, Homo sapiens
aagacgggaaggctg

SEQ ID NO: 79438 - DNA, 15 bp, Homo sapiens
agacgggaaggctgg

SEQ ID NO: 79439 - DNA, 15 bp, Homo sapiens
gacgggaaggctggc

SEQ ID NO: 79440 - DNA, 15 bp, Homo sapiens
acgggaaggctggct

SEQ ID NO: 79441 - DNA, 15 bp, Homo sapiens
cgggaaggctggctg

SEQ ID NO: 79442 - DNA, 15 bp, Homo sapiens
gggaaggctggctgt

SEQ ID NO: 79443 - DNA, 15 bp, Homo sapiens
ggaaggctggctgtg

SEQ ID NO: 79444 - DNA, 15 bp, Homo sapiens
gaaggctggctgtgg

SEQ ID NO: 79445 - DNA, 15 bp, Homo sapiens
aaggctggctgtgga

SEQ ID NO: 79446 - DNA, 15 bp, Homo sapiens
aggctggctgtggac

SEQ ID NO: 79447 - DNA, 15 bp, Homo sapiens
ggctggctgtggaca

SEQ ID NO: 79448 - DNA, 15 bp, Homo sapiens
gctggctgtggacac

SEQ ID NO: 79449 - DNA, 15 bp, Homo sapiens
ctggctgtggacacg

SEQ ID NO: 79450 - DNA, 15 bp, Homo sapiens
tggctgtggacacgg

SEQ ID NO: 79451 - DNA, 15 bp, Homo sapiens
ggctgtggacacgga

SEQ ID NO: 79452 - DNA, 15 bp, Homo sapiens
gctgtggacacggac

SEQ ID NO: 79453 - DNA, 15 bp, Homo sapiens
ctgtggacacggaca

SEQ ID NO: 79454 - DNA, 15 bp, Homo sapiens
tgtggacacggacac

SEQ ID NO: 79455 - DNA, 15 bp, Homo sapiens
gtggacacggacacc

SEQ ID NO: 79456 - DNA, 15 bp, Homo sapiens
tggacacggacacct

SEQ ID NO: 79457 - DNA, 15 bp, Homo sapiens
ggacacggacacctt

SEQ ID NO: 79458 - DNA, 15 bp, Homo sapiens
gacacggacaccttc

SEQ ID NO: 79459 - DNA, 15 bp, Homo sapiens
acacggacaccttca

SEQ ID NO: 79460 - DNA, 15 bp, Homo sapiens
cacggacaccttcag

SEQ ID NO: 79461 - DNA, 15 bp, Homo sapiens
acggacaccttcagc

SEQ ID NO: 79462 - DNA, 15 bp, Homo sapiens
cggacaccttcagct

SEQ ID NO: 79463 - DNA, 15 bp, Homo sapiens
ggacaccttcagctt

SEQ ID NO: 79464 - DNA, 15 bp, Homo sapiens
gacaccttcagcttt

SEQ ID NO: 79465 - DNA, 15 bp, Homo sapiens
acaccttcagctttg

SEQ ID NO: 79466 - DNA, 15 bp, Homo sapiens
caccttcagctttgg

SEQ ID NO: 79467 - DNA, 15 bp, Homo sapiens
accttcagctttggg

SEQ ID NO: 79468 - DNA, 15 bp, Homo sapiens
ccttcagctttgggg

SEQ ID NO: 79469 - DNA, 15 bp, Homo sapiens
cttcagctttggggt

SEQ ID NO: 79470 - DNA, 15 bp, Homo sapiens
ttcagctttggggtg

SEQ ID NO: 79471 - DNA, 15 bp, Homo sapiens
tcagctttggggtgg

SEQ ID NO: 79472 - DNA, 15 bp, Homo sapiens
cagctttggggtggt

SEQ ID NO: 79473 - DNA, 15 bp, Homo sapiens
agctttggggtggtg

SEQ ID NO: 79474 - DNA, 15 bp, Homo sapiens
gctttggggtggtga

SEQ ID NO: 79475 - DNA, 15 bp, Homo sapiens
ctttggggtggtgag

SEQ ID NO: 79476 - DNA, 15 bp, Homo sapiens
tttggggtggtgagc

SEQ ID NO: 79477 - DNA, 15 bp, Homo sapiens
ttggggtggtgagcc

SEQ ID NO: 79478 - DNA, 15 bp, Homo sapiens
tggggtggtgagcca

SEQ ID NO: 79479 - DNA, 15 bp, Homo sapiens
ggggtggtgagccac

SEQ ID NO: 79480 - DNA, 15 bp, Homo sapiens
gggtggtgagccact

SEQ ID NO: 79481 - DNA, 15 bp, Homo sapiens
ggtggtgagccactg

SEQ ID NO: 79482 - DNA, 15 bp, Homo sapiens
gtggtgagccactga

SEQ ID NO: 79483 - DNA, 15 bp, Homo sapiens
tggtgagccactgac

SEQ ID NO: 79484 - DNA, 15 bp, Homo sapiens
ggtgagccactgacc

SEQ ID NO: 79485 - DNA, 15 bp, Homo sapiens
gtgagccactgaccc

SEQ ID NO: 79486 - DNA, 15 bp, Homo sapiens
tgagccactgacccc

SEQ ID NO: 79487 - DNA, 15 bp, Homo sapiens
gagccactgacccct

SEQ ID NO: 79488 - DNA, 15 bp, Homo sapiens
agccactgacccctc

SEQ ID NO: 79489 - DNA, 15 bp, Homo sapiens
gccactgacccctct

SEQ ID NO: 79490 - DNA, 15 bp, Homo sapiens
ccactgacccctctg

SEQ ID NO: 79491 - DNA, 15 bp, Homo sapiens
cactgacccctctgc

SEQ ID NO: 79492 - DNA, 15 bp, Homo sapiens
actgacccctctgct

SEQ ID NO: 79493 - DNA, 15 bp, Homo sapiens
ctgacccctctgctg

SEQ ID NO: 79494 - DNA, 15 bp, Homo sapiens
tgacccctctgctgg

SEQ ID NO: 79495 - DNA, 15 bp, Homo sapiens
gacccctctgctggc

SEQ ID NO: 79496 - DNA, 15 bp, Homo sapiens
acccctctgctggct

SEQ ID NO: 79497 - DNA, 15 bp, Homo sapiens
cccctctgctggctc

SEQ ID NO: 79498 - DNA, 15 bp, Homo sapiens
ccctctgctggctca

SEQ ID NO: 79499 - DNA, 15 bp, Homo sapiens
cctctgctggctcag

SEQ ID NO: 79500 - DNA, 15 bp, Homo sapiens
ctctgctggctcaga

SEQ ID NO: 79501 - DNA, 15 bp, Homo sapiens
tctgctggctcagag

SEQ ID NO: 79502 - DNA, 15 bp, Homo sapiens
ctgctggctcagagg

SEQ ID NO: 79503 - DNA, 15 bp, Homo sapiens
tgctggctcagagga

SEQ ID NO: 79504 - DNA, 15 bp, Homo sapiens
gctggctcagaggag

SEQ ID NO: 79505 - DNA, 15 bp, Homo sapiens
ctggctcagaggagg

SEQ ID NO: 79506 - DNA, 15 bp, Homo sapiens
tggctcagaggagga

SEQ ID NO: 79507 - DNA, 15 bp, Homo sapiens
ggctcagaggaggag

SEQ ID NO: 79508 - DNA, 15 bp, Homo sapiens
gctcagaggaggaga

SEQ ID NO: 79509 - DNA, 15 bp, Homo sapiens
ctcagaggaggagaa

SEQ ID NO: 79510 - DNA, 15 bp, Homo sapiens
tcagaggaggagaag

SEQ ID NO: 79511 - DNA, 15 bp, Homo sapiens
cagaggaggagaagc

SEQ ID NO: 79512 - DNA, 15 bp, Homo sapiens
agaggaggagaagcc

SEQ ID NO: 79513 - DNA, 15 bp, Homo sapiens
gaggaggagaagcca

SEQ ID NO: 79514 - DNA, 15 bp, Homo sapiens
aggaggagaagccac

SEQ ID NO: 79515 - DNA, 15 bp, Homo sapiens
ggaggagaagccaca

SEQ ID NO: 79516 - DNA, 15 bp, Homo sapiens
gaggagaagccacag

SEQ ID NO: 79517 - DNA, 15 bp, Homo sapiens
aggagaagccacagg

SEQ ID NO: 79518 - DNA, 15 bp, Homo sapiens
ggagaagccacaggc

SEQ ID NO: 79519 - DNA, 15 bp, Homo sapiens
gagaagccacaggca

SEQ ID NO: 79520 - DNA, 15 bp, Homo sapiens
agaagccacaggcag

SEQ ID NO: 79521 - DNA, 15 bp, Homo sapiens
gaagccacaggcagg

SEQ ID NO: 79522 - DNA, 15 bp, Homo sapiens
aagccacaggcaggc

SEQ ID NO: 79523 - DNA, 15 bp, Homo sapiens
agccacaggcaggca

SEQ ID NO: 79524 - DNA, 15 bp, Homo sapiens
gccacaggcaggcag

SEQ ID NO: 79525 - DNA, 15 bp, Homo sapiens
ccacaggcaggcaga

SEQ ID NO: 79526 - DNA, 15 bp, Homo sapiens
cacaggcaggcagag

SEQ ID NO: 79527 - DNA, 15 bp, Homo sapiens
acaggcaggcagagg

SEQ ID NO: 79528 - DNA, 15 bp, Homo sapiens
caggcaggcagaggt

SEQ ID NO: 79529 - DNA, 15 bp, Homo sapiens
aggcaggcagaggtg

SEQ ID NO: 79530 - DNA, 15 bp, Homo sapiens
ggcaggcagaggtgg

SEQ ID NO: 79531 - DNA, 15 bp, Homo sapiens
gcaggcagaggtggg

SEQ ID NO: 79532 - DNA, 15 bp, Homo sapiens
caggcagaggtgggg

SEQ ID NO: 79533 - DNA, 15 bp, Homo sapiens
aggcagaggtggggg

SEQ ID NO: 79534 - DNA, 15 bp, Homo sapiens
ggcagaggtgggggc

SEQ ID NO: 79535 - DNA, 15 bp, Homo sapiens
gcagaggtgggggct

SEQ ID NO: 79536 - DNA, 15 bp, Homo sapiens
cagaggtgggggctg

SEQ ID NO: 79537 - DNA, 15 bp, Homo sapiens
agaggtgggggctgc

SEQ ID NO: 79538 - DNA, 15 bp, Homo sapiens
gaggtgggggctgca

SEQ ID NO: 79539 - DNA, 15 bp, Homo sapiens
aggtgggggctgcag

SEQ ID NO: 79540 - DNA, 15 bp, Homo sapiens
ggtgggggctgcaga

SEQ ID NO: 79541 - DNA, 15 bp, Homo sapiens
gtgggggctgcagag

SEQ ID NO: 79542 - DNA, 15 bp, Homo sapiens
tgggggctgcagagt

SEQ ID NO: 79543 - DNA, 15 bp, Homo sapiens
gggggctgcagagtg

SEQ ID NO: 79544 - DNA, 15 bp, Homo sapiens
ggggctgcagagtgc

SEQ ID NO: 79545 - DNA, 15 bp, Homo sapiens
gggctgcagagtgca

SEQ ID NO: 79546 - DNA, 15 bp, Homo sapiens
ggctgcagagtgcac

SEQ ID NO: 79547 - DNA, 15 bp, Homo sapiens
gctgcagagtgcact

SEQ ID NO: 79548 - DNA, 15 bp, Homo sapiens
ctgcagagtgcactg

SEQ ID NO: 79549 - DNA, 15 bp, Homo sapiens
tgcagagtgcactgc

SEQ ID NO: 79550 - DNA, 15 bp, Homo sapiens
gcagagtgcactgcg

SEQ ID NO: 79551 - DNA, 15 bp, Homo sapiens
cagagtgcactgcgg

SEQ ID NO: 79552 - DNA, 15 bp, Homo sapiens
agagtgcactgcggg

SEQ ID NO: 79553 - DNA, 15 bp, Homo sapiens
gagtgcactgcgggc

SEQ ID NO: 79554 - DNA, 15 bp, Homo sapiens
agtgcactgcgggcc

SEQ ID NO: 79555 - DNA, 15 bp, Homo sapiens
gtgcactgcgggcca

SEQ ID NO: 79556 - DNA, 15 bp, Homo sapiens
tgcactgcgggccag

SEQ ID NO: 79557 - DNA, 15 bp, Homo sapiens
gcactgcgggccagg

SEQ ID NO: 79558 - DNA, 15 bp, Homo sapiens
cactgcgggccaggg

SEQ ID NO: 79559 - DNA, 15 bp, Homo sapiens
actgcgggccagggg

SEQ ID NO: 79560 - DNA, 15 bp, Homo sapiens
ctgcgggccaggggc

SEQ ID NO: 79561 - DNA, 15 bp, Homo sapiens
tgcgggccaggggcc

SEQ ID NO: 79562 - DNA, 15 bp, Homo sapiens
gcgggccaggggcca

SEQ ID NO: 79563 - DNA, 15 bp, Homo sapiens
cgggccaggggccat

SEQ ID NO: 79564 - DNA, 15 bp, Homo sapiens
gggccaggggccatc

SEQ ID NO: 79565 - DNA, 15 bp, Homo sapiens
ggccaggggccatct

SEQ ID NO: 79566 - DNA, 15 bp, Homo sapiens
gccaggggccatctg

SEQ ID NO: 79567 - DNA, 15 bp, Homo sapiens
ccaggggccatctgc

SEQ ID NO: 79568 - DNA, 15 bp, Homo sapiens
caggggccatctgcc

SEQ ID NO: 79569 - DNA, 15 bp, Homo sapiens
aggggccatctgcca

SEQ ID NO: 79570 - DNA, 15 bp, Homo sapiens
ggggccatctgccaa

SEQ ID NO: 79571 - DNA, 15 bp, Homo sapiens
gggccatctgccaag

SEQ ID NO: 79572 - DNA, 15 bp, Homo sapiens
ggccatctgccaaga

SEQ ID NO: 79573 - DNA, 15 bp, Homo sapiens
gccatctgccaagac

SEQ ID NO: 79574 - DNA, 15 bp, Homo sapiens
ccatctgccaagacc

SEQ ID NO: 79575 - DNA, 15 bp, Homo sapiens
catctgccaagaccc

SEQ ID NO: 79576 - DNA, 15 bp, Homo sapiens
atctgccaagacccc

SEQ ID NO: 79577 - DNA, 15 bp, Homo sapiens
tctgccaagacccca

SEQ ID NO: 79578 - DNA, 15 bp, Homo sapiens
ctgccaagaccccag

SEQ ID NO: 79579 - DNA, 15 bp, Homo sapiens
tgccaagaccccagg

SEQ ID NO: 79580 - DNA, 15 bp, Homo sapiens
gccaagaccccagga

SEQ ID NO: 79581 - DNA, 15 bp, Homo sapiens
ccaagaccccaggag

SEQ ID NO: 79582 - DNA, 15 bp, Homo sapiens
caagaccccaggagg

SEQ ID NO: 79583 - DNA, 15 bp, Homo sapiens
aagaccccaggaggc

SEQ ID NO: 79584 - DNA, 15 bp, Homo sapiens
agaccccaggaggct

SEQ ID NO: 79585 - DNA, 15 bp, Homo sapiens
gaccccaggaggctg

SEQ ID NO: 79586 - DNA, 15 bp, Homo sapiens
accccaggaggctgc

SEQ ID NO: 79587 - DNA, 15 bp, Homo sapiens
ccccaggaggctgca

SEQ ID NO: 79588 - DNA, 15 bp, Homo sapiens
cccaggaggctgcag

SEQ ID NO: 79589 - DNA, 15 bp, Homo sapiens
ccaggaggctgcagc

SEQ ID NO: 79590 - DNA, 15 bp, Homo sapiens
caggaggctgcagct

SEQ ID NO: 79591 - DNA, 15 bp, Homo sapiens
aggaggctgcagctc

SEQ ID NO: 79592 - DNA, 15 bp, Homo sapiens
ggaggctgcagctcc

SEQ ID NO: 79593 - DNA, 15 bp, Homo sapiens
gaggctgcagctcca

SEQ ID NO: 79594 - DNA, 15 bp, Homo sapiens
aggctgcagctccag

SEQ ID NO: 79595 - DNA, 15 bp, Homo sapiens
ggctgcagctccagg

SEQ ID NO: 79596 - DNA, 15 bp, Homo sapiens
gctgcagctccaggg

SEQ ID NO: 79597 - DNA, 15 bp, Homo sapiens
ctgcagctccagggt

SEQ ID NO: 79598 - DNA, 15 bp, Homo sapiens
tgcagctccagggtc

SEQ ID NO: 79599 - DNA, 15 bp, Homo sapiens
gcagctccagggtcc

SEQ ID NO: 79600 - DNA, 15 bp, Homo sapiens
cagctccagggtccc

SEQ ID NO: 79601 - DNA, 15 bp, Homo sapiens
agctccagggtcccc

SEQ ID NO: 79602 - DNA, 15 bp, Homo sapiens
gctccagggtccccc

SEQ ID NO: 79603 - DNA, 15 bp, Homo sapiens
ctccagggtccccct

SEQ ID NO: 79604 - DNA, 15 bp, Homo sapiens
tccagggtccccctc

SEQ ID NO: 79605 - DNA, 15 bp, Homo sapiens
ccagggtccccctcc

SEQ ID NO: 79606 - DNA, 15 bp, Homo sapiens
cagggtccccctccc

SEQ ID NO: 79607 - DNA, 15 bp, Homo sapiens
agggtccccctccct

SEQ ID NO: 79608 - DNA, 15 bp, Homo sapiens
gggtccccctccctc

SEQ ID NO: 79609 - DNA, 15 bp, Homo sapiens
ggtccccctccctcc

SEQ ID NO: 79610 - DNA, 15 bp, Homo sapiens
gtccccctccctccg

SEQ ID NO: 79611 - DNA, 15 bp, Homo sapiens
ccccctccctccgag

SEQ ID NO: 79612 - DNA, 15 bp, Homo sapiens
cccctccctccgagg

SEQ ID NO: 79613 - DNA, 15 bp, Homo sapiens
ccctccctccgaggc

SEQ ID NO: 79614 - DNA, 15 bp, Homo sapiens
cctccctccgaggcc

SEQ ID NO: 79615 - DNA, 15 bp, Homo sapiens
ctccctccgaggccc

SEQ ID NO: 79616 - DNA, 15 bp, Homo sapiens
tccctccgaggccct

SEQ ID NO: 79617 - DNA, 15 bp, Homo sapiens
ccctccgaggccctc

SEQ ID NO: 79618 - DNA, 15 bp, Homo sapiens
cctccgaggccctcc

SEQ ID NO: 79619 - DNA, 15 bp, Homo sapiens
ctccgaggccctcct

SEQ ID NO: 79620 - DNA, 15 bp, Homo sapiens
tccgaggccctcctc

SEQ ID NO: 79621 - DNA, 15 bp, Homo sapiens
ccgaggccctcctcc

SEQ ID NO: 79622 - DNA, 15 bp, Homo sapiens
cgaggccctcctcct

SEQ ID NO: 79623 - DNA, 15 bp, Homo sapiens
gaggccctcctcctc

SEQ ID NO: 79624 - DNA, 15 bp, Homo sapiens
aggccctcctcctca

SEQ ID NO: 79625 - DNA, 15 bp, Homo sapiens
ggccctcctcctcac

SEQ ID NO: 79626 - DNA, 15 bp, Homo sapiens
gccctcctcctcacc

SEQ ID NO: 79627 - DNA, 15 bp, Homo sapiens
ccctcctcctcaccc

SEQ ID NO: 79628 - DNA, 15 bp, Homo sapiens
cctcctcctcaccct

SEQ ID NO: 79629 - DNA, 15 bp, Homo sapiens
ctcctcctcaccctg

SEQ ID NO: 79630 - DNA, 15 bp, Homo sapiens
tcctcctcaccctgc

SEQ ID NO: 79631 - DNA, 15 bp, Homo sapiens
cctcctcaccctgca

SEQ ID NO: 79632 - DNA, 15 bp, Homo sapiens
ctcctcaccctgcac

SEQ ID NO: 79633 - DNA, 15 bp, Homo sapiens
tcctcaccctgcacc

SEQ ID NO: 79634 - DNA, 15 bp, Homo sapiens
cctcaccctgcacct

SEQ ID NO: 79635 - DNA, 15 bp, Homo sapiens
ctcaccctgcaccta

SEQ ID NO: 79636 - DNA, 15 bp, Homo sapiens
tcaccctgcacctaa

SEQ ID NO: 79637 - DNA, 15 bp, Homo sapiens
caccctgcacctaac

SEQ ID NO: 79638 - DNA, 15 bp, Homo sapiens
accctgcacctaact

SEQ ID NO: 79639 - DNA, 15 bp, Homo sapiens
ccctgcacctaactg

SEQ ID NO: 79640 - DNA, 15 bp, Homo sapiens
cctgcacctaactgt

SEQ ID NO: 79641 - DNA, 15 bp, Homo sapiens
ctgcacctaactgtg

SEQ ID NO: 79642 - DNA, 15 bp, Homo sapiens
tgcacctaactgtgt

SEQ ID NO: 79643 - DNA, 15 bp, Homo sapiens
gcacctaactgtgtg

SEQ ID NO: 79644 - DNA, 15 bp, Homo sapiens
cacctaactgtgtgt

SEQ ID NO: 79645 - DNA, 15 bp, Homo sapiens
acctaactgtgtgtt

SEQ ID NO: 79646 - DNA, 15 bp, Homo sapiens
cctaactgtgtgttt

SEQ ID NO: 79647 - DNA, 15 bp, Homo sapiens
ctaactgtgtgtttg

SEQ ID NO: 79648 - DNA, 15 bp, Homo sapiens
taactgtgtgtttgt

SEQ ID NO: 79649 - DNA, 15 bp, Homo sapiens
aactgtgtgtttgta

SEQ ID NO: 79650 - DNA, 15 bp, Homo sapiens
actgtgtgtttgtaa

SEQ ID NO: 79651 - DNA, 15 bp, Homo sapiens
ctgtgtgtttgtaat

SEQ ID NO: 79652 - DNA, 15 bp, Homo sapiens
tgtgtgtttgtaatt

SEQ ID NO: 79653 - DNA, 15 bp, Homo sapiens
gtgtgtttgtaattt

SEQ ID NO: 79654 - DNA, 15 bp, Homo sapiens
tgtgtttgtaatttg

SEQ ID NO: 79655 - DNA, 15 bp, Homo sapiens
gtgtttgtaatttgt

SEQ ID NO: 79656 - DNA, 15 bp, Homo sapiens
tgtttgtaatttgtc

SEQ ID NO: 79657 - DNA, 15 bp, Homo sapiens
gtttgtaatttgtct

SEQ ID NO: 79658 - DNA, 15 bp, Homo sapiens
tttgtaatttgtctt

SEQ ID NO: 79659 - DNA, 15 bp, Homo sapiens
ttgtaatttgtcttc

SEQ ID NO: 79660 - DNA, 15 bp, Homo sapiens
tgtaatttgtcttca

SEQ ID NO: 79661 - DNA, 15 bp, Homo sapiens
gtaatttgtcttcaa

SEQ ID NO: 79662 - DNA, 15 bp, Homo sapiens
taatttgtcttcaag

SEQ ID NO: 79663 - DNA, 15 bp, Homo sapiens
aatttgtcttcaagt

SEQ ID NO: 79664 - DNA, 15 bp, Homo sapiens
atttgtcttcaagtg

SEQ ID NO: 79665 - DNA, 15 bp, Homo sapiens
tttgtcttcaagtgg

SEQ ID NO: 79666 - DNA, 15 bp, Homo sapiens
ttgtcttcaagtggg

SEQ ID NO: 79667 - DNA, 15 bp, Homo sapiens
tgtcttcaagtgggc

SEQ ID NO: 79668 - DNA, 15 bp, Homo sapiens
gtcttcaagtgggct

SEQ ID NO: 79669 - DNA, 15 bp, Homo sapiens
tcttcaagtgggctc

SEQ ID NO: 79670 - DNA, 15 bp, Homo sapiens
cttcaagtgggctct

SEQ ID NO: 79671 - DNA, 15 bp, Homo sapiens
ttcaagtgggctctc

SEQ ID NO: 79672 - DNA, 15 bp, Homo sapiens
tcaagtgggctctcc

SEQ ID NO: 79673 - DNA, 15 bp, Homo sapiens
caagtgggctctccg

SEQ ID NO: 79674 - DNA, 15 bp, Homo sapiens
aagtgggctctccga

SEQ ID NO: 79675 - DNA, 15 bp, Homo sapiens
agtgggctctccgag

SEQ ID NO: 79676 - DNA, 15 bp, Homo sapiens
gtgggctctccgagt

SEQ ID NO: 79677 - DNA, 15 bp, Homo sapiens
tgggctctccgagtt

SEQ ID NO: 79678 - DNA, 15 bp, Homo sapiens
gggctctccgagttg

SEQ ID NO: 79679 - DNA, 15 bp, Homo sapiens
ggctctccgagttgc

SEQ ID NO: 79680 - DNA, 15 bp, Homo sapiens
gctctccgagttgcc

SEQ ID NO: 79681 - DNA, 15 bp, Homo sapiens
ctctccgagttgccc

SEQ ID NO: 79682 - DNA, 15 bp, Homo sapiens
tctccgagttgcccg

SEQ ID NO: 79683 - DNA, 15 bp, Homo sapiens
ctccgagttgcccga

SEQ ID NO: 79684 - DNA, 15 bp, Homo sapiens
tccgagttgcccgag

SEQ ID NO: 79685 - DNA, 15 bp, Homo sapiens
ccgagttgcccgagc

SEQ ID NO: 79686 - DNA, 15 bp, Homo sapiens
cgagttgcccgagct

SEQ ID NO: 79687 - DNA, 15 bp, Homo sapiens
gagttgcccgagctt

SEQ ID NO: 79688 - DNA, 15 bp, Homo sapiens
agttgcccgagcttc

SEQ ID NO: 79689 - DNA, 15 bp, Homo sapiens
gttgcccgagcttca

SEQ ID NO: 79690 - DNA, 15 bp, Homo sapiens
ttgcccgagcttcag

SEQ ID NO: 79691 - DNA, 15 bp, Homo sapiens
tgcccgagcttcagt

SEQ ID NO: 79692 - DNA, 15 bp, Homo sapiens
gcccgagcttcagtc

SEQ ID NO: 79693 - DNA, 15 bp, Homo sapiens
cccgagcttcagtcc

SEQ ID NO: 79694 - DNA, 15 bp, Homo sapiens
ccgagcttcagtccc

SEQ ID NO: 79695 - DNA, 15 bp, Homo sapiens
cgagcttcagtccca

SEQ ID NO: 79696 - DNA, 15 bp, Homo sapiens
gagcttcagtcccat

SEQ ID NO: 79697 - DNA, 15 bp, Homo sapiens
agcttcagtcccata

SEQ ID NO: 79698 - DNA, 15 bp, Homo sapiens
gcttcagtcccataa

SEQ ID NO: 79699 - DNA, 15 bp, Homo sapiens
cttcagtcccataac

SEQ ID NO: 79700 - DNA, 15 bp, Homo sapiens
ttcagtcccataaca

SEQ ID NO: 79701 - DNA, 15 bp, Homo sapiens
tcagtcccataacat

SEQ ID NO: 79702 - DNA, 15 bp, Homo sapiens
cagtcccataacatc

SEQ ID NO: 79703 - DNA, 15 bp, Homo sapiens
agtcccataacatct

SEQ ID NO: 79704 - DNA, 15 bp, Homo sapiens
gtcccataacatctg

SEQ ID NO: 79705 - DNA, 15 bp, Homo sapiens
tcccataacatctgg

SEQ ID NO: 79706 - DNA, 15 bp, Homo sapiens
cccataacatctggc

SEQ ID NO: 79707 - DNA, 15 bp, Homo sapiens
ccataacatctggct

SEQ ID NO: 79708 - DNA, 15 bp, Homo sapiens
cataacatctggctc

SEQ ID NO: 79709 - DNA, 15 bp, Homo sapiens
ataacatctggctct

SEQ ID NO: 79710 - DNA, 15 bp, Homo sapiens
taacatctggctctg

SEQ ID NO: 79711 - DNA, 15 bp, Homo sapiens
aacatctggctctgc

SEQ ID NO: 79712 - DNA, 15 bp, Homo sapiens
acatctggctctgcc

SEQ ID NO: 79713 - DNA, 15 bp, Homo sapiens
catctggctctgcct

SEQ ID NO: 79714 - DNA, 15 bp, Homo sapiens
atctggctctgcctt

SEQ ID NO: 79715 - DNA, 15 bp, Homo sapiens
tctggctctgccttt

SEQ ID NO: 79716 - DNA, 15 bp, Homo sapiens
ctggctctgcctttg

SEQ ID NO: 79717 - DNA, 15 bp, Homo sapiens
tggctctgcctttgt

SEQ ID NO: 79718 - DNA, 15 bp, Homo sapiens
ggctctgcctttgtc

SEQ ID NO: 79719 - DNA, 15 bp, Homo sapiens
gctctgcctttgtcc

SEQ ID NO: 79720 - DNA, 15 bp, Homo sapiens
ctctgcctttgtcca

SEQ ID NO: 79721 - DNA, 15 bp, Homo sapiens
tctgcctttgtccac

SEQ ID NO: 79722 - DNA, 15 bp, Homo sapiens
ctgcctttgtccaca

SEQ ID NO: 79723 - DNA, 15 bp, Homo sapiens
tgcctttgtccacac

SEQ ID NO: 79724 - DNA, 15 bp, Homo sapiens
gcctttgtccacacc

SEQ ID NO: 79725 - DNA, 15 bp, Homo sapiens
cctttgtccacaccc

SEQ ID NO: 79726 - DNA, 15 bp, Homo sapiens
ctttgtccacaccct

SEQ ID NO: 79727 - DNA, 15 bp, Homo sapiens
tttgtccacaccctt

SEQ ID NO: 79728 - DNA, 15 bp, Homo sapiens
ttgtccacacccttg

SEQ ID NO: 79729 - DNA, 15 bp, Homo sapiens
tgtccacacccttgt

SEQ ID NO: 79730 - DNA, 15 bp, Homo sapiens
gtccacacccttgtc

SEQ ID NO: 79731 - DNA, 15 bp, Homo sapiens
tccacacccttgtca

SEQ ID NO: 79732 - DNA, 15 bp, Homo sapiens
ccacacccttgtcag

SEQ ID NO: 79733 - DNA, 15 bp, Homo sapiens
cacacccttgtcagg

SEQ ID NO: 79734 - DNA, 15 bp, Homo sapiens
acacccttgtcaggc

SEQ ID NO: 79735 - DNA, 15 bp, Homo sapiens
cacccttgtcaggcc

SEQ ID NO: 79736 - DNA, 15 bp, Homo sapiens
acccttgtcaggccc

SEQ ID NO: 79737 - DNA, 15 bp, Homo sapiens
cccttgtcaggccca

SEQ ID NO: 79738 - DNA, 15 bp, Homo sapiens
ccttgtcaggcccaa

SEQ ID NO: 79739 - DNA, 15 bp, Homo sapiens
cttgtcaggcccaat

SEQ ID NO: 79740 - DNA, 15 bp, Homo sapiens
ttgtcaggcccaatc

SEQ ID NO: 79741 - DNA, 15 bp, Homo sapiens
tgtcaggcccaatcc

SEQ ID NO: 79742 - DNA, 15 bp, Homo sapiens
gtcaggcccaatcca

SEQ ID NO: 79743 - DNA, 15 bp, Homo sapiens
tcaggcccaatccat

SEQ ID NO: 79744 - DNA, 15 bp, Homo sapiens
caggcccaatccatg

SEQ ID NO: 79745 - DNA, 15 bp, Homo sapiens
aggcccaatccatgt

SEQ ID NO: 79746 - DNA, 15 bp, Homo sapiens
ggcccaatccatgtc

SEQ ID NO: 79747 - DNA, 15 bp, Homo sapiens
gcccaatccatgtcc

SEQ ID NO: 79748 - DNA, 15 bp, Homo sapiens
cccaatccatgtcca

SEQ ID NO: 79749 - DNA, 15 bp, Homo sapiens
ccaatccatgtccac

SEQ ID NO: 79750 - DNA, 15 bp, Homo sapiens
caatccatgtccaca

SEQ ID NO: 79751 - DNA, 15 bp, Homo sapiens
aatccatgtccacac

SEQ ID NO: 79752 - DNA, 15 bp, Homo sapiens
atccatgtccacacc

SEQ ID NO: 79753 - DNA, 15 bp, Homo sapiens
tccatgtccacacca

SEQ ID NO: 79754 - DNA, 15 bp, Homo sapiens
ccatgtccacaccag

SEQ ID NO: 79755 - DNA, 15 bp, Homo sapiens
catgtccacaccaga

SEQ ID NO: 79756 - DNA, 15 bp, Homo sapiens
atgtccacaccagag

SEQ ID NO: 79757 - DNA, 15 bp, Homo sapiens
tgtccacaccagagg

SEQ ID NO: 79758 - DNA, 15 bp, Homo sapiens
gtccacaccagaggc

SEQ ID NO: 79759 - DNA, 15 bp, Homo sapiens
tccacaccagaggcc

SEQ ID NO: 79760 - DNA, 15 bp, Homo sapiens
ccacaccagaggcct

SEQ ID NO: 79761 - DNA, 15 bp, Homo sapiens
cacaccagaggcctc

SEQ ID NO: 79762 - DNA, 15 bp, Homo sapiens
acaccagaggcctct

SEQ ID NO: 79763 - DNA, 15 bp, Homo sapiens
caccagaggcctctt

SEQ ID NO: 79764 - DNA, 15 bp, Homo sapiens
accagaggcctcttc

SEQ ID NO: 79765 - DNA, 15 bp, Homo sapiens
ccagaggcctcttcc

SEQ ID NO: 79766 - DNA, 15 bp, Homo sapiens
cagaggcctcttccc

SEQ ID NO: 79767 - DNA, 15 bp, Homo sapiens
agaggcctcttccct

SEQ ID NO: 79768 - DNA, 15 bp, Homo sapiens
gaggcctcttccctg

SEQ ID NO: 79769 - DNA, 15 bp, Homo sapiens
aggcctcttccctgc

SEQ ID NO: 79770 - DNA, 15 bp, Homo sapiens
ggcctcttccctgcc

SEQ ID NO: 79771 - DNA, 15 bp, Homo sapiens
gcctcttccctgcca

SEQ ID NO: 79772 - DNA, 15 bp, Homo sapiens
cctcttccctgccaa

SEQ ID NO: 79773 - DNA, 15 bp, Homo sapiens
ctcttccctgccaag

SEQ ID NO: 79774 - DNA, 15 bp, Homo sapiens
tcttccctgccaagg

SEQ ID NO: 79775 - DNA, 15 bp, Homo sapiens
cttccctgccaaggc

SEQ ID NO: 79776 - DNA, 15 bp, Homo sapiens
ttccctgccaaggcc

SEQ ID NO: 79777 - DNA, 15 bp, Homo sapiens
tccctgccaaggcca

SEQ ID NO: 79778 - DNA, 15 bp, Homo sapiens
ccctgccaaggccac

SEQ ID NO: 79779 - DNA, 15 bp, Homo sapiens
cctgccaaggccact

SEQ ID NO: 79780 - DNA, 15 bp, Homo sapiens
ctgccaaggccactg

SEQ ID NO: 79781 - DNA, 15 bp, Homo sapiens
tgccaaggccactgc

SEQ ID NO: 79782 - DNA, 15 bp, Homo sapiens
gccaaggccactgcc

SEQ ID NO: 79783 - DNA, 15 bp, Homo sapiens
ccaaggccactgcca

SEQ ID NO: 79784 - DNA, 15 bp, Homo sapiens
caaggccactgccat

SEQ ID NO: 79785 - DNA, 15 bp, Homo sapiens
aaggccactgccatg

SEQ ID NO: 79786 - DNA, 15 bp, Homo sapiens
aggccactgccatgc

SEQ ID NO: 79787 - DNA, 15 bp, Homo sapiens
ggccactgccatgct

SEQ ID NO: 79788 - DNA, 15 bp, Homo sapiens
gccactgccatgctc

SEQ ID NO: 79789 - DNA, 15 bp, Homo sapiens
ccactgccatgctct

SEQ ID NO: 79790 - DNA, 15 bp, Homo sapiens
cactgccatgctctc

SEQ ID NO: 79791 - DNA, 15 bp, Homo sapiens
actgccatgctctcc

SEQ ID NO: 79792 - DNA, 15 bp, Homo sapiens
ctgccatgctctccc

SEQ ID NO: 79793 - DNA, 15 bp, Homo sapiens
tgccatgctctccct

SEQ ID NO: 79794 - DNA, 15 bp, Homo sapiens
gccatgctctccctc

SEQ ID NO: 79795 - DNA, 15 bp, Homo sapiens
ccatgctctccctct

SEQ ID NO: 79796 - DNA, 15 bp, Homo sapiens
catgctctccctctt

SEQ ID NO: 79797 - DNA, 15 bp, Homo sapiens
atgctctccctcttc

SEQ ID NO: 79798 - DNA, 15 bp, Homo sapiens
tgctctccctcttcc

SEQ ID NO: 79799 - DNA, 15 bp, Homo sapiens
gctctccctcttccc

SEQ ID NO: 79800 - DNA, 15 bp, Homo sapiens
ctctccctcttccct

SEQ ID NO: 79801 - DNA, 15 bp, Homo sapiens
tctccctcttccctc

SEQ ID NO: 79802 - DNA, 15 bp, Homo sapiens
ctccctcttccctct

SEQ ID NO: 79803 - DNA, 15 bp, Homo sapiens
tccctcttccctctc

SEQ ID NO: 79804 - DNA, 15 bp, Homo sapiens
ccctcttccctctct

SEQ ID NO: 79805 - DNA, 15 bp, Homo sapiens
cctcttccctctctc

SEQ ID NO: 79806 - DNA, 15 bp, Homo sapiens
ctcttccctctctcc

SEQ ID NO: 79807 - DNA, 15 bp, Homo sapiens
tcttccctctctcca

SEQ ID NO: 79808 - DNA, 15 bp, Homo sapiens
cttccctctctccag

SEQ ID NO: 79809 - DNA, 15 bp, Homo sapiens
ttccctctctccagg

SEQ ID NO: 79810 - DNA, 15 bp, Homo sapiens
tccctctctccaggt

SEQ ID NO: 79811 - DNA, 15 bp, Homo sapiens
ccctctctccaggta

SEQ ID NO: 79812 - DNA, 15 bp, Homo sapiens
cctctctccaggtag

SEQ ID NO: 79813 - DNA, 15 bp, Homo sapiens
ctctctccaggtagt

SEQ ID NO: 79814 - DNA, 15 bp, Homo sapiens
tctctccaggtagtg

SEQ ID NO: 79815 - DNA, 15 bp, Homo sapiens
ctctccaggtagtgc

SEQ ID NO: 79816 - DNA, 15 bp, Homo sapiens
tctccaggtagtgct

SEQ ID NO: 79817 - DNA, 15 bp, Homo sapiens
ctccaggtagtgcta

SEQ ID NO: 79818 - DNA, 15 bp, Homo sapiens
tccaggtagtgctag

SEQ ID NO: 79819 - DNA, 15 bp, Homo sapiens
ccaggtagtgctaga

SEQ ID NO: 79820 - DNA, 15 bp, Homo sapiens
caggtagtgctagag

SEQ ID NO: 79821 - DNA, 15 bp, Homo sapiens
aggtagtgctagaga

SEQ ID NO: 79822 - DNA, 15 bp, Homo sapiens
ggtagtgctagagac

SEQ ID NO: 79823 - DNA, 15 bp, Homo sapiens
gtagtgctagagacc

SEQ ID NO: 79824 - DNA, 15 bp, Homo sapiens
tagtgctagagacct

SEQ ID NO: 79825 - DNA, 15 bp, Homo sapiens
agtgctagagacctt

SEQ ID NO: 79826 - DNA, 15 bp, Homo sapiens
gtgctagagaccttg

SEQ ID NO: 79827 - DNA, 15 bp, Homo sapiens
tgctagagaccttgg

SEQ ID NO: 79828 - DNA, 15 bp, Homo sapiens
gctagagaccttggc

SEQ ID NO: 79829 - DNA, 15 bp, Homo sapiens
ctagagaccttggct

SEQ ID NO: 79830 - DNA, 15 bp, Homo sapiens
tagagaccttggctg

SEQ ID NO: 79831 - DNA, 15 bp, Homo sapiens
agagaccttggctgg

SEQ ID NO: 79832 - DNA, 15 bp, Homo sapiens
gagaccttggctggt

SEQ ID NO: 79833 - DNA, 15 bp, Homo sapiens
agaccttggctggtc

SEQ ID NO: 79834 - DNA, 15 bp, Homo sapiens
gaccttggctggtca

SEQ ID NO: 79835 - DNA, 15 bp, Homo sapiens
accttggctggtcag

SEQ ID NO: 79836 - DNA, 15 bp, Homo sapiens
ccttggctggtcaga

SEQ ID NO: 79837 - DNA, 15 bp, Homo sapiens
cttggctggtcagag

SEQ ID NO: 79838 - DNA, 15 bp, Homo sapiens
ttggctggtcagagg

SEQ ID NO: 79839 - DNA, 15 bp, Homo sapiens
tggctggtcagaggg

SEQ ID NO: 79840 - DNA, 15 bp, Homo sapiens
ggctggtcagagggc

SEQ ID NO: 79841 - DNA, 15 bp, Homo sapiens
gctggtcagagggct

SEQ ID NO: 79842 - DNA, 15 bp, Homo sapiens
ctggtcagagggctg

SEQ ID NO: 79843 - DNA, 15 bp, Homo sapiens
tggtcagagggctgt

SEQ ID NO: 79844 - DNA, 15 bp, Homo sapiens
ggtcagagggctgtg

SEQ ID NO: 79845 - DNA, 15 bp, Homo sapiens
gtcagagggctgtga

SEQ ID NO: 79846 - DNA, 15 bp, Homo sapiens
tcagagggctgtgaa

SEQ ID NO: 79847 - DNA, 15 bp, Homo sapiens
cagagggctgtgaag

SEQ ID NO: 79848 - DNA, 15 bp, Homo sapiens
agagggctgtgaaga

SEQ ID NO: 79849 - DNA, 15 bp, Homo sapiens
gagggctgtgaagac

SEQ ID NO: 79850 - DNA, 15 bp, Homo sapiens
agggctgtgaagacg

SEQ ID NO: 79851 - DNA, 15 bp, Homo sapiens
gggctgtgaagacgc

SEQ ID NO: 79852 - DNA, 15 bp, Homo sapiens
ggctgtgaagacgca

SEQ ID NO: 79853 - DNA, 15 bp, Homo sapiens
gctgtgaagacgcac

SEQ ID NO: 79854 - DNA, 15 bp, Homo sapiens
ctgtgaagacgcacg

SEQ ID NO: 79855 - DNA, 15 bp, Homo sapiens
tgtgaagacgcacgg

SEQ ID NO: 79856 - DNA, 15 bp, Homo sapiens
gtgaagacgcacggt

SEQ ID NO: 79857 - DNA, 15 bp, Homo sapiens
tgaagacgcacggtg

SEQ ID NO: 79858 - DNA, 15 bp, Homo sapiens
gaagacgcacggtgc

SEQ ID NO: 79859 - DNA, 15 bp, Homo sapiens
aagacgcacggtgcc

SEQ ID NO: 79860 - DNA, 15 bp, Homo sapiens
agacgcacggtgcca

SEQ ID NO: 79861 - DNA, 15 bp, Homo sapiens
gacgcacggtgccag

SEQ ID NO: 79862 - DNA, 15 bp, Homo sapiens
acgcacggtgccagg

SEQ ID NO: 79863 - DNA, 15 bp, Homo sapiens
cgcacggtgccagga

SEQ ID NO: 79864 - DNA, 15 bp, Homo sapiens
gcacggtgccaggac

SEQ ID NO: 79865 - DNA, 15 bp, Homo sapiens
cacggtgccaggacc

SEQ ID NO: 79866 - DNA, 15 bp, Homo sapiens
acggtgccaggacca

SEQ ID NO: 79867 - DNA, 15 bp, Homo sapiens
cggtgccaggaccaa

SEQ ID NO: 79868 - DNA, 15 bp, Homo sapiens
ggtgccaggaccaag

SEQ ID NO: 79869 - DNA, 15 bp, Homo sapiens
gtgccaggaccaagt

SEQ ID NO: 79870 - DNA, 15 bp, Homo sapiens
tgccaggaccaagta

SEQ ID NO: 79871 - DNA, 15 bp, Homo sapiens
gccaggaccaagtat

SEQ ID NO: 79872 - DNA, 15 bp, Homo sapiens
ccaggaccaagtatc

SEQ ID NO: 79873 - DNA, 15 bp, Homo sapiens
caggaccaagtatct

SEQ ID NO: 79874 - DNA, 15 bp, Homo sapiens
aggaccaagtatctg

SEQ ID NO: 79875 - DNA, 15 bp, Homo sapiens
ggaccaagtatctgg

SEQ ID NO: 79876 - DNA, 15 bp, Homo sapiens
gaccaagtatctggt

SEQ ID NO: 79877 - DNA, 15 bp, Homo sapiens
accaagtatctggtg

SEQ ID NO: 79878 - DNA, 15 bp, Homo sapiens
ccaagtatctggtga

SEQ ID NO: 79879 - DNA, 15 bp, Homo sapiens
caagtatctggtgag

SEQ ID NO: 79880 - DNA, 15 bp, Homo sapiens
aagtatctggtgagc

SEQ ID NO: 79881 - DNA, 15 bp, Homo sapiens
agtatctggtgagcc

SEQ ID NO: 79882 - DNA, 15 bp, Homo sapiens
gtatctggtgagccc

SEQ ID NO: 79883 - DNA, 15 bp, Homo sapiens
tatctggtgagcccc

SEQ ID NO: 79884 - DNA, 15 bp, Homo sapiens
atctggtgagcccct

SEQ ID NO: 79885 - DNA, 15 bp, Homo sapiens
tctggtgagcccctt

SEQ ID NO: 79886 - DNA, 15 bp, Homo sapiens
ctggtgagccccttg

SEQ ID NO: 79887 - DNA, 15 bp, Homo sapiens
tggtgagccccttga

SEQ ID NO: 79888 - DNA, 15 bp, Homo sapiens
ggtgagccccttgag

SEQ ID NO: 79889 - DNA, 15 bp, Homo sapiens
gtgagccccttgagg

SEQ ID NO: 79890 - DNA, 15 bp, Homo sapiens
tgagccccttgaggc

SEQ ID NO: 79891 - DNA, 15 bp, Homo sapiens
gagccccttgaggca

SEQ ID NO: 79892 - DNA, 15 bp, Homo sapiens
agccccttgaggcag

SEQ ID NO: 79893 - DNA, 15 bp, Homo sapiens
gccccttgaggcagg

SEQ ID NO: 79894 - DNA, 15 bp, Homo sapiens
ccccttgaggcaggg

SEQ ID NO: 79895 - DNA, 15 bp, Homo sapiens
cccttgaggcagggc

SEQ ID NO: 79896 - DNA, 15 bp, Homo sapiens
ccttgaggcagggcc

SEQ ID NO: 79897 - DNA, 15 bp, Homo sapiens
cttgaggcagggcca

SEQ ID NO: 79898 - DNA, 15 bp, Homo sapiens
ttgaggcagggccag

SEQ ID NO: 79899 - DNA, 15 bp, Homo sapiens
tgaggcagggccagg

SEQ ID NO: 79900 - DNA, 15 bp, Homo sapiens
gaggcagggccagga

SEQ ID NO: 79901 - DNA, 15 bp, Homo sapiens
aggcagggccaggag

SEQ ID NO: 79902 - DNA, 15 bp, Homo sapiens
ggcagggccaggagg

SEQ ID NO: 79903 - DNA, 15 bp, Homo sapiens
gcagggccaggaggg

SEQ ID NO: 79904 - DNA, 15 bp, Homo sapiens
cagggccaggaggga

SEQ ID NO: 79905 - DNA, 15 bp, Homo sapiens
agggccaggagggac

SEQ ID NO: 79906 - DNA, 15 bp, Homo sapiens
gggccaggagggaca

SEQ ID NO: 79907 - DNA, 15 bp, Homo sapiens
ggccaggagggacac

SEQ ID NO: 79908 - DNA, 15 bp, Homo sapiens
gccaggagggacaca

SEQ ID NO: 79909 - DNA, 15 bp, Homo sapiens
ccaggagggacacac

SEQ ID NO: 79910 - DNA, 15 bp, Homo sapiens
caggagggacacaca

SEQ ID NO: 79911 - DNA, 15 bp, Homo sapiens
aggagggacacacag

SEQ ID NO: 79912 - DNA, 15 bp, Homo sapiens
ggagggacacacagc

SEQ ID NO: 79913 - DNA, 15 bp, Homo sapiens
gagggacacacagct

SEQ ID NO: 79914 - DNA, 15 bp, Homo sapiens
agggacacacagctg

SEQ ID NO: 79915 - DNA, 15 bp, Homo sapiens
gggacacacagctgc

SEQ ID NO: 79916 - DNA, 15 bp, Homo sapiens
ggacacacagctgct

SEQ ID NO: 79917 - DNA, 15 bp, Homo sapiens
gacacacagctgctg

SEQ ID NO: 79918 - DNA, 15 bp, Homo sapiens
acacacagctgctgg

SEQ ID NO: 79919 - DNA, 15 bp, Homo sapiens
cacacagctgctggc

SEQ ID NO: 79920 - DNA, 15 bp, Homo sapiens
acacagctgctggca

SEQ ID NO: 79921 - DNA, 15 bp, Homo sapiens
cacagctgctggcag

SEQ ID NO: 79922 - DNA, 15 bp, Homo sapiens
acagctgctggcagc

SEQ ID NO: 79923 - DNA, 15 bp, Homo sapiens
cagctgctggcagcc

SEQ ID NO: 79924 - DNA, 15 bp, Homo sapiens
agctgctggcagcca

SEQ ID NO: 79925 - DNA, 15 bp, Homo sapiens
gctgctggcagccag

SEQ ID NO: 79926 - DNA, 15 bp, Homo sapiens
ctgctggcagccagc

SEQ ID NO: 79927 - DNA, 15 bp, Homo sapiens
tgctggcagccagca

SEQ ID NO: 79928 - DNA, 15 bp, Homo sapiens
gctggcagccagcag

SEQ ID NO: 79929 - DNA, 15 bp, Homo sapiens
ctggcagccagcagg

SEQ ID NO: 79930 - DNA, 15 bp, Homo sapiens
tggcagccagcaggc

SEQ ID NO: 79931 - DNA, 15 bp, Homo sapiens
ggcagccagcaggca

SEQ ID NO: 79932 - DNA, 15 bp, Homo sapiens
gcagccagcaggcac

SEQ ID NO: 79933 - DNA, 15 bp, Homo sapiens
cagccagcaggcaca

SEQ ID NO: 79934 - DNA, 15 bp, Homo sapiens
agccagcaggcacag

SEQ ID NO: 79935 - DNA, 15 bp, Homo sapiens
gccagcaggcacagc

SEQ ID NO: 79936 - DNA, 15 bp, Homo sapiens
ccagcaggcacagcc

SEQ ID NO: 79937 - DNA, 15 bp, Homo sapiens
cagcaggcacagccc

SEQ ID NO: 79938 - DNA, 15 bp, Homo sapiens
agcaggcacagcccc

SEQ ID NO: 79939 - DNA, 15 bp, Homo sapiens
gcaggcacagcccca

SEQ ID NO: 79940 - DNA, 15 bp, Homo sapiens
caggcacagccccag

SEQ ID NO: 79941 - DNA, 15 bp, Homo sapiens
aggcacagccccagt

SEQ ID NO: 79942 - DNA, 15 bp, Homo sapiens
ggcacagccccagtg

SEQ ID NO: 79943 - DNA, 15 bp, Homo sapiens
gcacagccccagtgg

SEQ ID NO: 79944 - DNA, 15 bp, Homo sapiens
cacagccccagtggc

SEQ ID NO: 79945 - DNA, 15 bp, Homo sapiens
acagccccagtggcg

SEQ ID NO: 79946 - DNA, 15 bp, Homo sapiens
cagccccagtggcgg

SEQ ID NO: 79947 - DNA, 15 bp, Homo sapiens
agccccagtggcggg

SEQ ID NO: 79948 - DNA, 15 bp, Homo sapiens
gccccagtggcgggg

SEQ ID NO: 79949 - DNA, 15 bp, Homo sapiens
ccccagtggcgggga

SEQ ID NO: 79950 - DNA, 15 bp, Homo sapiens
cccagtggcggggat

SEQ ID NO: 79951 - DNA, 15 bp, Homo sapiens
ccagtggcggggata

SEQ ID NO: 79952 - DNA, 15 bp, Homo sapiens
cagtggcggggataa

SEQ ID NO: 79953 - DNA, 15 bp, Homo sapiens
agtggcggggataac

SEQ ID NO: 79954 - DNA, 15 bp, Homo sapiens
gtggcggggataact

SEQ ID NO: 79955 - DNA, 15 bp, Homo sapiens
tggcggggataactg

SEQ ID NO: 79956 - DNA, 15 bp, Homo sapiens
ggcggggataactgg

SEQ ID NO: 79957 - DNA, 15 bp, Homo sapiens
gcggggataactggg

SEQ ID NO: 79958 - DNA, 15 bp, Homo sapiens
cggggataactgggg

SEQ ID NO: 79959 - DNA, 15 bp, Homo sapiens
ggggataactggggc

SEQ ID NO: 79960 - DNA, 15 bp, Homo sapiens
gggataactggggcg

SEQ ID NO: 79961 - DNA, 15 bp, Homo sapiens
ggataactggggcgc

SEQ ID NO: 79962 - DNA, 15 bp, Homo sapiens
gataactggggcgca

SEQ ID NO: 79963 - DNA, 15 bp, Homo sapiens
ataactggggcgcag

SEQ ID NO: 79964 - DNA, 15 bp, Homo sapiens
taactggggcgcagt

SEQ ID NO: 79965 - DNA, 15 bp, Homo sapiens
aactggggcgcagtg

SEQ ID NO: 79966 - DNA, 15 bp, Homo sapiens
actggggcgcagtgc

SEQ ID NO: 79967 - DNA, 15 bp, Homo sapiens
ctggggcgcagtgcc

SEQ ID NO: 79968 - DNA, 15 bp, Homo sapiens
tggggcgcagtgccc

SEQ ID NO: 79969 - DNA, 15 bp, Homo sapiens
ggggcgcagtgccca

SEQ ID NO: 79970 - DNA, 15 bp, Homo sapiens
gggcgcagtgcccat

SEQ ID NO: 79971 - DNA, 15 bp, Homo sapiens
ggcgcagtgcccatg

SEQ ID NO: 79972 - DNA, 15 bp, Homo sapiens
gcgcagtgcccatgg

SEQ ID NO: 79973 - DNA, 15 bp, Homo sapiens
cgcagtgcccatgga

SEQ ID NO: 79974 - DNA, 15 bp, Homo sapiens
gcagtgcccatggat

SEQ ID NO: 79975 - DNA, 15 bp, Homo sapiens
cagtgcccatggatg

SEQ ID NO: 79976 - DNA, 15 bp, Homo sapiens
agtgcccatggatgc

SEQ ID NO: 79977 - DNA, 15 bp, Homo sapiens
gtgcccatggatgcc

SEQ ID NO: 79978 - DNA, 15 bp, Homo sapiens
tgcccatggatgcct

SEQ ID NO: 79979 - DNA, 15 bp, Homo sapiens
gcccatggatgcctc

SEQ ID NO: 79980 - DNA, 15 bp, Homo sapiens
cccatggatgcctct

SEQ ID NO: 79981 - DNA, 15 bp, Homo sapiens
ccatggatgcctctg

SEQ ID NO: 79982 - DNA, 15 bp, Homo sapiens
catggatgcctctgc

SEQ ID NO: 79983 - DNA, 15 bp, Homo sapiens
atggatgcctctgct

SEQ ID NO: 79984 - DNA, 15 bp, Homo sapiens
tggatgcctctgctg

SEQ ID NO: 79985 - DNA, 15 bp, Homo sapiens
ggatgcctctgctgc

SEQ ID NO: 79986 - DNA, 15 bp, Homo sapiens
gatgcctctgctgcc

SEQ ID NO: 79987 - DNA, 15 bp, Homo sapiens
atgcctctgctgcca

SEQ ID NO: 79988 - DNA, 15 bp, Homo sapiens
tgcctctgctgccac

SEQ ID NO: 79989 - DNA, 15 bp, Homo sapiens
gcctctgctgccaca

SEQ ID NO: 79990 - DNA, 15 bp, Homo sapiens
cctctgctgccacag

SEQ ID NO: 79991 - DNA, 15 bp, Homo sapiens
ctctgctgccacagt

SEQ ID NO: 79992 - DNA, 15 bp, Homo sapiens
tctgctgccacagtg

SEQ ID NO: 79993 - DNA, 15 bp, Homo sapiens
ctgctgccacagtgg

SEQ ID NO: 79994 - DNA, 15 bp, Homo sapiens
tgctgccacagtggc

SEQ ID NO: 79995 - DNA, 15 bp, Homo sapiens
gctgccacagtggcc

SEQ ID NO: 79996 - DNA, 15 bp, Homo sapiens
ctgccacagtggcct

SEQ ID NO: 79997 - DNA, 15 bp, Homo sapiens
tgccacagtggcctc

SEQ ID NO: 79998 - DNA, 15 bp, Homo sapiens
gccacagtggcctca

SEQ ID NO: 79999 - DNA, 15 bp, Homo sapiens
ccacagtggcctcat

SEQ ID NO: 80000 - DNA, 15 bp, Homo sapiens
cacagtggcctcatt

SEQ ID NO: 80001 - DNA, 15 bp, Homo sapiens
acagtggcctcattt

SEQ ID NO: 80002 - DNA, 15 bp, Homo sapiens
cagtggcctcatttt

SEQ ID NO: 80003 - DNA, 15 bp, Homo sapiens
agtggcctcattttt

SEQ ID NO: 80004 - DNA, 15 bp, Homo sapiens
gtggcctcatttttg

SEQ ID NO: 80005 - DNA, 15 bp, Homo sapiens
tggcctcatttttga

SEQ ID NO: 80006 - DNA, 15 bp, Homo sapiens
ggcctcatttttgaa

SEQ ID NO: 80007 - DNA, 15 bp, Homo sapiens
gcctcatttttgaaa

SEQ ID NO: 80008 - DNA, 15 bp, Homo sapiens
cctcatttttgaaag

SEQ ID NO: 80009 - DNA, 15 bp, Homo sapiens
ctcatttttgaaagt

SEQ ID NO: 80010 - DNA, 15 bp, Homo sapiens
tcatttttgaaagta

SEQ ID NO: 80011 - DNA, 15 bp, Homo sapiens
catttttgaaagtag

SEQ ID NO: 80012 - DNA, 15 bp, Homo sapiens
atttttgaaagtagg

SEQ ID NO: 80013 - DNA, 15 bp, Homo sapiens
tttttgaaagtaggc

SEQ ID NO: 80014 - DNA, 15 bp, Homo sapiens
ttttgaaagtaggca

SEQ ID NO: 80015 - DNA, 15 bp, Homo sapiens
tttgaaagtaggcag

SEQ ID NO: 80016 - DNA, 15 bp, Homo sapiens
ttgaaagtaggcagg

SEQ ID NO: 80017 - DNA, 15 bp, Homo sapiens
tgaaagtaggcaggg

SEQ ID NO: 80018 - DNA, 15 bp, Homo sapiens
gaaagtaggcagggc

SEQ ID NO: 80019 - DNA, 15 bp, Homo sapiens
aaagtaggcagggct

SEQ ID NO: 80020 - DNA, 15 bp, Homo sapiens
aagtaggcagggctc

SEQ ID NO: 80021 - DNA, 15 bp, Homo sapiens
agtaggcagggctcc

SEQ ID NO: 80022 - DNA, 15 bp, Homo sapiens
gtaggcagggctcca

SEQ ID NO: 80023 - DNA, 15 bp, Homo sapiens
taggcagggctccaa

SEQ ID NO: 80024 - DNA, 15 bp, Homo sapiens
aggcagggctccaaa

SEQ ID NO: 80025 - DNA, 15 bp, Homo sapiens
ggcagggctccaaac

SEQ ID NO: 80026 - DNA, 15 bp, Homo sapiens
gcagggctccaaaca

SEQ ID NO: 80027 - DNA, 15 bp, Homo sapiens
cagggctccaaacaa

SEQ ID NO: 80028 - DNA, 15 bp, Homo sapiens
agggctccaaacaac

SEQ ID NO: 80029 - DNA, 15 bp, Homo sapiens
gggctccaaacaact

SEQ ID NO: 80030 - DNA, 15 bp, Homo sapiens
ggctccaaacaactt

SEQ ID NO: 80031 - DNA, 15 bp, Homo sapiens
gctccaaacaacttc

SEQ ID NO: 80032 - DNA, 15 bp, Homo sapiens
ctccaaacaacttcg

SEQ ID NO: 80033 - DNA, 15 bp, Homo sapiens
tccaaacaacttcgt

SEQ ID NO: 80034 - DNA, 15 bp, Homo sapiens
ccaaacaacttcgtt

SEQ ID NO: 80035 - DNA, 15 bp, Homo sapiens
caaacaacttcgttt

SEQ ID NO: 80036 - DNA, 15 bp, Homo sapiens
aaacaacttcgttta

SEQ ID NO: 80037 - DNA, 15 bp, Homo sapiens
aacaacttcgtttac

SEQ ID NO: 80038 - DNA, 15 bp, Homo sapiens
acaacttcgtttacc

SEQ ID NO: 80039 - DNA, 15 bp, Homo sapiens
caacttcgtttacct

SEQ ID NO: 80040 - DNA, 15 bp, Homo sapiens
aacttcgtttacctt

SEQ ID NO: 80041 - DNA, 15 bp, Homo sapiens
acttcgtttaccttg

SEQ ID NO: 80042 - DNA, 15 bp, Homo sapiens
cttcgtttaccttgc

SEQ ID NO: 80043 - DNA, 15 bp, Homo sapiens
ttcgtttaccttgcc

SEQ ID NO: 80044 - DNA, 15 bp, Homo sapiens
tcgtttaccttgccg

SEQ ID NO: 80045 - DNA, 15 bp, Homo sapiens
cgtttaccttgccga

SEQ ID NO: 80046 - DNA, 15 bp, Homo sapiens
gtttaccttgccgag

SEQ ID NO: 80047 - DNA, 15 bp, Homo sapiens
tttaccttgccgagg

SEQ ID NO: 80048 - DNA, 15 bp, Homo sapiens
ttaccttgccgagga

SEQ ID NO: 80049 - DNA, 15 bp, Homo sapiens
taccttgccgaggac

SEQ ID NO: 80050 - DNA, 15 bp, Homo sapiens
accttgccgaggaca

SEQ ID NO: 80051 - DNA, 15 bp, Homo sapiens
ccttgccgaggacaa

SEQ ID NO: 80052 - DNA, 15 bp, Homo sapiens
cttgccgaggacaaa

SEQ ID NO: 80053 - DNA, 15 bp, Homo sapiens
ttgccgaggacaaac

SEQ ID NO: 80054 - DNA, 15 bp, Homo sapiens
tgccgaggacaaacc

SEQ ID NO: 80055 - DNA, 15 bp, Homo sapiens
gccgaggacaaacct

SEQ ID NO: 80056 - DNA, 15 bp, Homo sapiens
ccgaggacaaacctg

SEQ ID NO: 80057 - DNA, 15 bp, Homo sapiens
cgaggacaaacctgt

SEQ ID NO: 80058 - DNA, 15 bp, Homo sapiens
gaggacaaacctgtc

SEQ ID NO: 80059 - DNA, 15 bp, Homo sapiens
aggacaaacctgtct

SEQ ID NO: 80060 - DNA, 15 bp, Homo sapiens
ggacaaacctgtctg

SEQ ID NO: 80061 - DNA, 15 bp, Homo sapiens
gacaaacctgtctgt

SEQ ID NO: 80062 - DNA, 15 bp, Homo sapiens
acaaacctgtctgtc

SEQ ID NO: 80063 - DNA, 15 bp, Homo sapiens
caaacctgtctgtcc

SEQ ID NO: 80064 - DNA, 15 bp, Homo sapiens
aaacctgtctgtcct

SEQ ID NO: 80065 - DNA, 15 bp, Homo sapiens
aacctgtctgtcctg

SEQ ID NO: 80066 - DNA, 15 bp, Homo sapiens
acctgtctgtcctgc

SEQ ID NO: 80067 - DNA, 15 bp, Homo sapiens
cctgtctgtcctgca

SEQ ID NO: 80068 - DNA, 15 bp, Homo sapiens
ctgtctgtcctgcag

SEQ ID NO: 80069 - DNA, 15 bp, Homo sapiens
tgtctgtcctgcaga

SEQ ID NO: 80070 - DNA, 15 bp, Homo sapiens
gtctgtcctgcagac

SEQ ID NO: 80071 - DNA, 15 bp, Homo sapiens
tctgtcctgcagaca

SEQ ID NO: 80072 - DNA, 15 bp, Homo sapiens
ctgtcctgcagacac

SEQ ID NO: 80073 - DNA, 15 bp, Homo sapiens
tgtcctgcagacact

SEQ ID NO: 80074 - DNA, 15 bp, Homo sapiens
gtcctgcagacacta

SEQ ID NO: 80075 - DNA, 15 bp, Homo sapiens
tcctgcagacactat

SEQ ID NO: 80076 - DNA, 15 bp, Homo sapiens
cctgcagacactatg

SEQ ID NO: 80077 - DNA, 15 bp, Homo sapiens
ctgcagacactatgg

SEQ ID NO: 80078 - DNA, 15 bp, Homo sapiens
tgcagacactatggg

SEQ ID NO: 80079 - DNA, 15 bp, Homo sapiens
gcagacactatgggc

SEQ ID NO: 80080 - DNA, 15 bp, Homo sapiens
cagacactatgggcc

SEQ ID NO: 80081 - DNA, 15 bp, Homo sapiens
agacactatgggcct

SEQ ID NO: 80082 - DNA, 15 bp, Homo sapiens
gacactatgggcctt

SEQ ID NO: 80083 - DNA, 15 bp, Homo sapiens
acactatgggccttg

SEQ ID NO: 80084 - DNA, 15 bp, Homo sapiens
cactatgggccttgt

SEQ ID NO: 80085 - DNA, 15 bp, Homo sapiens
actatgggccttgta

SEQ ID NO: 80086 - DNA, 15 bp, Homo sapiens
ctatgggccttgtac

SEQ ID NO: 80087 - DNA, 15 bp, Homo sapiens
tatgggccttgtaca

SEQ ID NO: 80088 - DNA, 15 bp, Homo sapiens
atgggccttgtacag

SEQ ID NO: 80089 - DNA, 15 bp, Homo sapiens
tgggccttgtacaga

SEQ ID NO: 80090 - DNA, 15 bp, Homo sapiens
gggccttgtacagac

SEQ ID NO: 80091 - DNA, 15 bp, Homo sapiens
ggccttgtacagacc

SEQ ID NO: 80092 - DNA, 15 bp, Homo sapiens
gccttgtacagaccc

SEQ ID NO: 80093 - DNA, 15 bp, Homo sapiens
ccttgtacagacccc

SEQ ID NO: 80094 - DNA, 15 bp, Homo sapiens
cttgtacagacccca

SEQ ID NO: 80095 - DNA, 15 bp, Homo sapiens
ttgtacagaccccac

SEQ ID NO: 80096 - DNA, 15 bp, Homo sapiens
tgtacagaccccacc

SEQ ID NO: 80097 - DNA, 15 bp, Homo sapiens
gtacagaccccacct

SEQ ID NO: 80098 - DNA, 15 bp, Homo sapiens
tacagaccccacctg

SEQ ID NO: 80099 - DNA, 15 bp, Homo sapiens
acagaccccacctgg

SEQ ID NO: 80100 - DNA, 15 bp, Homo sapiens
cagaccccacctggg

SEQ ID NO: 80101 - DNA, 15 bp, Homo sapiens
agaccccacctgggc

SEQ ID NO: 80102 - DNA, 15 bp, Homo sapiens
gaccccacctgggct

SEQ ID NO: 80103 - DNA, 15 bp, Homo sapiens
accccacctgggctg

SEQ ID NO: 80104 - DNA, 15 bp, Homo sapiens
ccccacctgggctgg

SEQ ID NO: 80105 - DNA, 15 bp, Homo sapiens
cccacctgggctggg

SEQ ID NO: 80106 - DNA, 15 bp, Homo sapiens
ccacctgggctgggg

SEQ ID NO: 80107 - DNA, 15 bp, Homo sapiens
cacctgggctggggg

SEQ ID NO: 80108 - DNA, 15 bp, Homo sapiens
acctgggctgggggc

SEQ ID NO: 80109 - DNA, 15 bp, Homo sapiens
cctgggctgggggca

SEQ ID NO: 80110 - DNA, 15 bp, Homo sapiens
ctgggctgggggcag

SEQ ID NO: 80111 - DNA, 15 bp, Homo sapiens
tgggctgggggcagg

SEQ ID NO: 80112 - DNA, 15 bp, Homo sapiens
gggctgggggcaggg

SEQ ID NO: 80113 - DNA, 15 bp, Homo sapiens
ggctgggggcagggg

SEQ ID NO: 80114 - DNA, 15 bp, Homo sapiens
gctgggggcaggggg

SEQ ID NO: 80115 - DNA, 15 bp, Homo sapiens
ctgggggcaggggga

SEQ ID NO: 80116 - DNA, 15 bp, Homo sapiens
tgggggcagggggaa

SEQ ID NO: 80117 - DNA, 15 bp, Homo sapiens
gggggcagggggaag

SEQ ID NO: 80118 - DNA, 15 bp, Homo sapiens
ggggcagggggaagg

SEQ ID NO: 80119 - DNA, 15 bp, Homo sapiens
gggcagggggaaggg

SEQ ID NO: 80120 - DNA, 15 bp, Homo sapiens
ggcagggggaagggc

SEQ ID NO: 80121 - DNA, 15 bp, Homo sapiens
gcagggggaagggcg

SEQ ID NO: 80122 - DNA, 15 bp, Homo sapiens
cagggggaagggcgg

SEQ ID NO: 80123 - DNA, 15 bp, Homo sapiens
agggggaagggcggt

SEQ ID NO: 80124 - DNA, 15 bp, Homo sapiens
gggggaagggcggtc

SEQ ID NO: 80125 - DNA, 15 bp, Homo sapiens
ggggaagggcggtcc

SEQ ID NO: 80126 - DNA, 15 bp, Homo sapiens
gggaagggcggtccc

SEQ ID NO: 80127 - DNA, 15 bp, Homo sapiens
ggaagggcggtccca

SEQ ID NO: 80128 - DNA, 15 bp, Homo sapiens
gaagggcggtcccag

SEQ ID NO: 80129 - DNA, 15 bp, Homo sapiens
aagggcggtcccagg

SEQ ID NO: 80130 - DNA, 15 bp, Homo sapiens
agggcggtcccaggg

SEQ ID NO: 80131 - DNA, 15 bp, Homo sapiens
gggcggtcccagggc

SEQ ID NO: 80132 - DNA, 15 bp, Homo sapiens
ggcggtcccagggca

SEQ ID NO: 80133 - DNA, 15 bp, Homo sapiens
gcggtcccagggcac

SEQ ID NO: 80134 - DNA, 15 bp, Homo sapiens
cggtcccagggcact

SEQ ID NO: 80135 - DNA, 15 bp, Homo sapiens
ggtcccagggcactg

SEQ ID NO: 80136 - DNA, 15 bp, Homo sapiens
gtcccagggcactga

SEQ ID NO: 80137 - DNA, 15 bp, Homo sapiens
tcccagggcactgag

SEQ ID NO: 80138 - DNA, 15 bp, Homo sapiens
cccagggcactgaga

SEQ ID NO: 80139 - DNA, 15 bp, Homo sapiens
ccagggcactgagac

SEQ ID NO: 80140 - DNA, 15 bp, Homo sapiens
cagggcactgagacc

SEQ ID NO: 80141 - DNA, 15 bp, Homo sapiens
agggcactgagaccc

SEQ ID NO: 80142 - DNA, 15 bp, Homo sapiens
gggcactgagaccca

SEQ ID NO: 80143 - DNA, 15 bp, Homo sapiens
ggcactgagacccaa

SEQ ID NO: 80144 - DNA, 15 bp, Homo sapiens
gcactgagacccaag

SEQ ID NO: 80145 - DNA, 15 bp, Homo sapiens
cactgagacccaagc

SEQ ID NO: 80146 - DNA, 15 bp, Homo sapiens
actgagacccaagct

SEQ ID NO: 80147 - DNA, 15 bp, Homo sapiens
ctgagacccaagctg

SEQ ID NO: 80148 - DNA, 15 bp, Homo sapiens
tgagacccaagctgc

SEQ ID NO: 80149 - DNA, 15 bp, Homo sapiens
gagacccaagctgca

SEQ ID NO: 80150 - DNA, 15 bp, Homo sapiens
agacccaagctgcag

SEQ ID NO: 80151 - DNA, 15 bp, Homo sapiens
gacccaagctgcagt

SEQ ID NO: 80152 - DNA, 15 bp, Homo sapiens
acccaagctgcagtg

SEQ ID NO: 80153 - DNA, 15 bp, Homo sapiens
cccaagctgcagtgg

SEQ ID NO: 80154 - DNA, 15 bp, Homo sapiens
ccaagctgcagtgga

SEQ ID NO: 80155 - DNA, 15 bp, Homo sapiens
caagctgcagtggaa

SEQ ID NO: 80156 - DNA, 15 bp, Homo sapiens
aagctgcagtggaac

SEQ ID NO: 80157 - DNA, 15 bp, Homo sapiens
agctgcagtggaact

SEQ ID NO: 80158 - DNA, 15 bp, Homo sapiens
gctgcagtggaactc

SEQ ID NO: 80159 - DNA, 15 bp, Homo sapiens
ctgcagtggaactca

SEQ ID NO: 80160 - DNA, 15 bp, Homo sapiens
tgcagtggaactcag

SEQ ID NO: 80161 - DNA, 15 bp, Homo sapiens
gcagtggaactcaga

SEQ ID NO: 80162 - DNA, 15 bp, Homo sapiens
cagtggaactcagag

SEQ ID NO: 80163 - DNA, 15 bp, Homo sapiens
agtggaactcagagg

SEQ ID NO: 80164 - DNA, 15 bp, Homo sapiens
gtggaactcagagga

SEQ ID NO: 80165 - DNA, 15 bp, Homo sapiens
tggaactcagaggac

SEQ ID NO: 80166 - DNA, 15 bp, Homo sapiens
ggaactcagaggact

SEQ ID NO: 80167 - DNA, 15 bp, Homo sapiens
gaactcagaggactc

SEQ ID NO: 80168 - DNA, 15 bp, Homo sapiens
aactcagaggactct

SEQ ID NO: 80169 - DNA, 15 bp, Homo sapiens
actcagaggactctg

SEQ ID NO: 80170 - DNA, 15 bp, Homo sapiens
ctcagaggactctgg

SEQ ID NO: 80171 - DNA, 15 bp, Homo sapiens
tcagaggactctggc

SEQ ID NO: 80172 - DNA, 15 bp, Homo sapiens
cagaggactctggcc

SEQ ID NO: 80173 - DNA, 15 bp, Homo sapiens
agaggactctggccg

SEQ ID NO: 80174 - DNA, 15 bp, Homo sapiens
gaggactctggccgg

SEQ ID NO: 80175 - DNA, 15 bp, Homo sapiens
aggactctggccgga

SEQ ID NO: 80176 - DNA, 15 bp, Homo sapiens
ggactctggccggag

SEQ ID NO: 80177 - DNA, 15 bp, Homo sapiens
gactctggccggaga

SEQ ID NO: 80178 - DNA, 15 bp, Homo sapiens
actctggccggagaa

SEQ ID NO: 80179 - DNA, 15 bp, Homo sapiens
ctctggccggagaaa

SEQ ID NO: 80180 - DNA, 15 bp, Homo sapiens
tctggccggagaaag

SEQ ID NO: 80181 - DNA, 15 bp, Homo sapiens
ctggccggagaaagg

SEQ ID NO: 80182 - DNA, 15 bp, Homo sapiens
tggccggagaaaggc

SEQ ID NO: 80183 - DNA, 15 bp, Homo sapiens
ggccggagaaaggcg

SEQ ID NO: 80184 - DNA, 15 bp, Homo sapiens
gccggagaaaggcgg

SEQ ID NO: 80185 - DNA, 15 bp, Homo sapiens
ccggagaaaggcggt

SEQ ID NO: 80186 - DNA, 15 bp, Homo sapiens
cggagaaaggcggtg

SEQ ID NO: 80187 - DNA, 15 bp, Homo sapiens
ggagaaaggcggtgg

SEQ ID NO: 80188 - DNA, 15 bp, Homo sapiens
gagaaaggcggtggt

SEQ ID NO: 80189 - DNA, 15 bp, Homo sapiens
agaaaggcggtggta

SEQ ID NO: 80190 - DNA, 15 bp, Homo sapiens
gaaaggcggtggtag

SEQ ID NO: 80191 - DNA, 15 bp, Homo sapiens
aaaggcggtggtaga

SEQ ID NO: 80192 - DNA, 15 bp, Homo sapiens
aaggcggtggtagag

SEQ ID NO: 80193 - DNA, 15 bp, Homo sapiens
aggcggtggtagaga

SEQ ID NO: 80194 - DNA, 15 bp, Homo sapiens
ggcggtggtagagaa

SEQ ID NO: 80195 - DNA, 15 bp, Homo sapiens
gcggtggtagagaag

SEQ ID NO: 80196 - DNA, 15 bp, Homo sapiens
cggtggtagagaaga

SEQ ID NO: 80197 - DNA, 15 bp, Homo sapiens
ggtggtagagaagaa

SEQ ID NO: 80198 - DNA, 15 bp, Homo sapiens
gtggtagagaagaag

SEQ ID NO: 80199 - DNA, 15 bp, Homo sapiens
tggtagagaagaagc

SEQ ID NO: 80200 - DNA, 15 bp, Homo sapiens
ggtagagaagaagca

SEQ ID NO: 80201 - DNA, 15 bp, Homo sapiens
gtagagaagaagcag

SEQ ID NO: 80202 - DNA, 15 bp, Homo sapiens
tagagaagaagcagg

SEQ ID NO: 80203 - DNA, 15 bp, Homo sapiens
agagaagaagcaggc

SEQ ID NO: 80204 - DNA, 15 bp, Homo sapiens
gagaagaagcaggcc

SEQ ID NO: 80205 - DNA, 15 bp, Homo sapiens
agaagaagcaggccc

SEQ ID NO: 80206 - DNA, 15 bp, Homo sapiens
gaagaagcaggcccc

SEQ ID NO: 80207 - DNA, 15 bp, Homo sapiens
aagaagcaggccccg

SEQ ID NO: 80208 - DNA, 15 bp, Homo sapiens
agaagcaggccccga

SEQ ID NO: 80209 - DNA, 15 bp, Homo sapiens
gaagcaggccccgag

SEQ ID NO: 80210 - DNA, 15 bp, Homo sapiens
aagcaggccccgagg

SEQ ID NO: 80211 - DNA, 15 bp, Homo sapiens
agcaggccccgagga

SEQ ID NO: 80212 - DNA, 15 bp, Homo sapiens
gcaggccccgaggaa

SEQ ID NO: 80213 - DNA, 15 bp, Homo sapiens
caggccccgaggaac

SEQ ID NO: 80214 - DNA, 15 bp, Homo sapiens
aggccccgaggaacc

SEQ ID NO: 80215 - DNA, 15 bp, Homo sapiens
ggccccgaggaacct

SEQ ID NO: 80216 - DNA, 15 bp, Homo sapiens
gccccgaggaacctc

SEQ ID NO: 80217 - DNA, 15 bp, Homo sapiens
ccccgaggaacctcc

SEQ ID NO: 80218 - DNA, 15 bp, Homo sapiens
cccgaggaacctcct

SEQ ID NO: 80219 - DNA, 15 bp, Homo sapiens
ccgaggaacctcctg

SEQ ID NO: 80220 - DNA, 15 bp, Homo sapiens
cgaggaacctcctgg

SEQ ID NO: 80221 - DNA, 15 bp, Homo sapiens
gaggaacctcctggg

SEQ ID NO: 80222 - DNA, 15 bp, Homo sapiens
aggaacctcctgggc

SEQ ID NO: 80223 - DNA, 15 bp, Homo sapiens
ggaacctcctgggcc

SEQ ID NO: 80224 - DNA, 15 bp, Homo sapiens
gaacctcctgggccc

SEQ ID NO: 80225 - DNA, 15 bp, Homo sapiens
aacctcctgggcccc

SEQ ID NO: 80226 - DNA, 15 bp, Homo sapiens
acctcctgggcccca

SEQ ID NO: 80227 - DNA, 15 bp, Homo sapiens
cctcctgggccccag

SEQ ID NO: 80228 - DNA, 15 bp, Homo sapiens
ctcctgggccccagc

SEQ ID NO: 80229 - DNA, 15 bp, Homo sapiens
tcctgggccccagca

SEQ ID NO: 80230 - DNA, 15 bp, Homo sapiens
cctgggccccagcag

SEQ ID NO: 80231 - DNA, 15 bp, Homo sapiens
ctgggccccagcagg

SEQ ID NO: 80232 - DNA, 15 bp, Homo sapiens
tgggccccagcaggc

SEQ ID NO: 80233 - DNA, 15 bp, Homo sapiens
gggccccagcaggct

SEQ ID NO: 80234 - DNA, 15 bp, Homo sapiens
ggccccagcaggctg

SEQ ID NO: 80235 - DNA, 15 bp, Homo sapiens
gccccagcaggctgc

SEQ ID NO: 80236 - DNA, 15 bp, Homo sapiens
ccccagcaggctgca

SEQ ID NO: 80237 - DNA, 15 bp, Homo sapiens
cccagcaggctgcag

SEQ ID NO: 80238 - DNA, 15 bp, Homo sapiens
ccagcaggctgcagc

SEQ ID NO: 80239 - DNA, 15 bp, Homo sapiens
cagcaggctgcagct

SEQ ID NO: 80240 - DNA, 15 bp, Homo sapiens
agcaggctgcagctg

SEQ ID NO: 80241 - DNA, 15 bp, Homo sapiens
gcaggctgcagctga

SEQ ID NO: 80242 - DNA, 15 bp, Homo sapiens
caggctgcagctgag

SEQ ID NO: 80243 - DNA, 15 bp, Homo sapiens
aggctgcagctgagc

SEQ ID NO: 80244 - DNA, 15 bp, Homo sapiens
ggctgcagctgagct

SEQ ID NO: 80245 - DNA, 15 bp, Homo sapiens
gctgcagctgagctc

SEQ ID NO: 80246 - DNA, 15 bp, Homo sapiens
ctgcagctgagctct

SEQ ID NO: 80247 - DNA, 15 bp, Homo sapiens
tgcagctgagctctc

SEQ ID NO: 80248 - DNA, 15 bp, Homo sapiens
gcagctgagctctcc

SEQ ID NO: 80249 - DNA, 15 bp, Homo sapiens
cagctgagctctccg

SEQ ID NO: 80250 - DNA, 15 bp, Homo sapiens
agctgagctctccgc

SEQ ID NO: 80251 - DNA, 15 bp, Homo sapiens
gctgagctctccgca

SEQ ID NO: 80252 - DNA, 15 bp, Homo sapiens
ctgagctctccgcac

SEQ ID NO: 80253 - DNA, 15 bp, Homo sapiens
tgagctctccgcacc

SEQ ID NO: 80254 - DNA, 15 bp, Homo sapiens
gagctctccgcaccg

SEQ ID NO: 80255 - DNA, 15 bp, Homo sapiens
agctctccgcaccgt

SEQ ID NO: 80256 - DNA, 15 bp, Homo sapiens
gctctccgcaccgtg

SEQ ID NO: 80257 - DNA, 15 bp, Homo sapiens
ctctccgcaccgtgc

SEQ ID NO: 80258 - DNA, 15 bp, Homo sapiens
tctccgcaccgtgca

SEQ ID NO: 80259 - DNA, 15 bp, Homo sapiens
ctccgcaccgtgcag

SEQ ID NO: 80260 - DNA, 15 bp, Homo sapiens
tccgcaccgtgcagg

SEQ ID NO: 80261 - DNA, 15 bp, Homo sapiens
ccgcaccgtgcaggg

SEQ ID NO: 80262 - DNA, 15 bp, Homo sapiens
cgcaccgtgcagggc

SEQ ID NO: 80263 - DNA, 15 bp, Homo sapiens
gcaccgtgcagggca

SEQ ID NO: 80264 - DNA, 15 bp, Homo sapiens
caccgtgcagggcag

SEQ ID NO: 80265 - DNA, 15 bp, Homo sapiens
accgtgcagggcagc

SEQ ID NO: 80266 - DNA, 15 bp, Homo sapiens
ccgtgcagggcagcc

SEQ ID NO: 80267 - DNA, 15 bp, Homo sapiens
cgtgcagggcagcct

SEQ ID NO: 80268 - DNA, 15 bp, Homo sapiens
gtgcagggcagcctg

SEQ ID NO: 80269 - DNA, 15 bp, Homo sapiens
tgcagggcagcctga

SEQ ID NO: 80270 - DNA, 15 bp, Homo sapiens
gcagggcagcctgag

SEQ ID NO: 80271 - DNA, 15 bp, Homo sapiens
cagggcagcctgagc

SEQ ID NO: 80272 - DNA, 15 bp, Homo sapiens
agggcagcctgagct

SEQ ID NO: 80273 - DNA, 15 bp, Homo sapiens
gggcagcctgagctg

SEQ ID NO: 80274 - DNA, 15 bp, Homo sapiens
ggcagcctgagctgc

SEQ ID NO: 80275 - DNA, 15 bp, Homo sapiens
gcagcctgagctgcc

SEQ ID NO: 80276 - DNA, 15 bp, Homo sapiens
cagcctgagctgcct

SEQ ID NO: 80277 - DNA, 15 bp, Homo sapiens
agcctgagctgcctc

SEQ ID NO: 80278 - DNA, 15 bp, Homo sapiens
gcctgagctgcctca

SEQ ID NO: 80279 - DNA, 15 bp, Homo sapiens
cctgagctgcctcac

SEQ ID NO: 80280 - DNA, 15 bp, Homo sapiens
ctgagctgcctcacg

SEQ ID NO: 80281 - DNA, 15 bp, Homo sapiens
tgagctgcctcacgg

SEQ ID NO: 80282 - DNA, 15 bp, Homo sapiens
gagctgcctcacggt

SEQ ID NO: 80283 - DNA, 15 bp, Homo sapiens
agctgcctcacggtc

SEQ ID NO: 80284 - DNA, 15 bp, Homo sapiens
gctgcctcacggtct

SEQ ID NO: 80285 - DNA, 15 bp, Homo sapiens
ctgcctcacggtctt

SEQ ID NO: 80286 - DNA, 15 bp, Homo sapiens
tgcctcacggtctta

SEQ ID NO: 80287 - DNA, 15 bp, Homo sapiens
gcctcacggtcttac

SEQ ID NO: 80288 - DNA, 15 bp, Homo sapiens
cctcacggtcttact

SEQ ID NO: 80289 - DNA, 15 bp, Homo sapiens
ctcacggtcttactc

SEQ ID NO: 80290 - DNA, 15 bp, Homo sapiens
tcacggtcttactcc

SEQ ID NO: 80291 - DNA, 15 bp, Homo sapiens
cacggtcttactcca

SEQ ID NO: 80292 - DNA, 15 bp, Homo sapiens
acggtcttactccac

SEQ ID NO: 80293 - DNA, 15 bp, Homo sapiens
cggtcttactccact

SEQ ID NO: 80294 - DNA, 15 bp, Homo sapiens
ggtcttactccactc

SEQ ID NO: 80295 - DNA, 15 bp, Homo sapiens
gtcttactccactca

SEQ ID NO: 80296 - DNA, 15 bp, Homo sapiens
tcttactccactcag

SEQ ID NO: 80297 - DNA, 15 bp, Homo sapiens
cttactccactcagt

SEQ ID NO: 80298 - DNA, 15 bp, Homo sapiens
ttactccactcagtc

SEQ ID NO: 80299 - DNA, 15 bp, Homo sapiens
tactccactcagtct

SEQ ID NO: 80300 - DNA, 15 bp, Homo sapiens
actccactcagtctg

SEQ ID NO: 80301 - DNA, 15 bp, Homo sapiens
ctccactcagtctgc

SEQ ID NO: 80302 - DNA, 15 bp, Homo sapiens
tccactcagtctgcc

SEQ ID NO: 80303 - DNA, 15 bp, Homo sapiens
ccactcagtctgcct

SEQ ID NO: 80304 - DNA, 15 bp, Homo sapiens
cactcagtctgcctc

SEQ ID NO: 80305 - DNA, 15 bp, Homo sapiens
actcagtctgcctca

SEQ ID NO: 80306 - DNA, 15 bp, Homo sapiens
ctcagtctgcctcac

SEQ ID NO: 80307 - DNA, 15 bp, Homo sapiens
tcagtctgcctcacc

SEQ ID NO: 80308 - DNA, 15 bp, Homo sapiens
cagtctgcctcaccg

SEQ ID NO: 80309 - DNA, 15 bp, Homo sapiens
agtctgcctcaccgt

SEQ ID NO: 80310 - DNA, 15 bp, Homo sapiens
gtctgcctcaccgtg

SEQ ID NO: 80311 - DNA, 15 bp, Homo sapiens
tctgcctcaccgtgg

SEQ ID NO: 80312 - DNA, 15 bp, Homo sapiens
ctgcctcaccgtgga

SEQ ID NO: 80313 - DNA, 15 bp, Homo sapiens
tgcctcaccgtggac

SEQ ID NO: 80314 - DNA, 15 bp, Homo sapiens
gcctcaccgtggact

SEQ ID NO: 80315 - DNA, 15 bp, Homo sapiens
cctcaccgtggactg

SEQ ID NO: 80316 - DNA, 15 bp, Homo sapiens
ctcaccgtggactgt

SEQ ID NO: 80317 - DNA, 15 bp, Homo sapiens
tcaccgtggactgtg

SEQ ID NO: 80318 - DNA, 15 bp, Homo sapiens
caccgtggactgtgg

SEQ ID NO: 80319 - DNA, 15 bp, Homo sapiens
accgtggactgtggt

SEQ ID NO: 80320 - DNA, 15 bp, Homo sapiens
ccgtggactgtggtg

SEQ ID NO: 80321 - DNA, 15 bp, Homo sapiens
cgtggactgtggtgg

SEQ ID NO: 80322 - DNA, 15 bp, Homo sapiens
gtggactgtggtggg

SEQ ID NO: 80323 - DNA, 15 bp, Homo sapiens
tggactgtggtgggg

SEQ ID NO: 80324 - DNA, 15 bp, Homo sapiens
ggactgtggtggggc

SEQ ID NO: 80325 - DNA, 15 bp, Homo sapiens
gactgtggtggggcc

SEQ ID NO: 80326 - DNA, 15 bp, Homo sapiens
actgtggtggggcca

SEQ ID NO: 80327 - DNA, 15 bp, Homo sapiens
ctgtggtggggccag

SEQ ID NO: 80328 - DNA, 15 bp, Homo sapiens
tgtggtggggccagg

SEQ ID NO: 80329 - DNA, 15 bp, Homo sapiens
gtggtggggccagga

SEQ ID NO: 80330 - DNA, 15 bp, Homo sapiens
tggtggggccaggag

SEQ ID NO: 80331 - DNA, 15 bp, Homo sapiens
ggtggggccaggaga

SEQ ID NO: 80332 - DNA, 15 bp, Homo sapiens
gtggggccaggagac

SEQ ID NO: 80333 - DNA, 15 bp, Homo sapiens
tggggccaggagact

SEQ ID NO: 80334 - DNA, 15 bp, Homo sapiens
ggggccaggagacta

SEQ ID NO: 80335 - DNA, 15 bp, Homo sapiens
gggccaggagactag

SEQ ID NO: 80336 - DNA, 15 bp, Homo sapiens
ggccaggagactaga

SEQ ID NO: 80337 - DNA, 15 bp, Homo sapiens
gccaggagactagag

SEQ ID NO: 80338 - DNA, 15 bp, Homo sapiens
ccaggagactagaga

SEQ ID NO: 80339 - DNA, 15 bp, Homo sapiens
caggagactagagac

SEQ ID NO: 80340 - DNA, 15 bp, Homo sapiens
aggagactagagacc

SEQ ID NO: 80341 - DNA, 15 bp, Homo sapiens
ggagactagagacct

SEQ ID NO: 80342 - DNA, 15 bp, Homo sapiens
gagactagagacctg

SEQ ID NO: 80343 - DNA, 15 bp, Homo sapiens
agactagagacctgg

SEQ ID NO: 80344 - DNA, 15 bp, Homo sapiens
gactagagacctggg

SEQ ID NO: 80345 - DNA, 15 bp, Homo sapiens
actagagacctgggt

SEQ ID NO: 80346 - DNA, 15 bp, Homo sapiens
ctagagacctgggtt

SEQ ID NO: 80347 - DNA, 15 bp, Homo sapiens
tagagacctgggttt

SEQ ID NO: 80348 - DNA, 15 bp, Homo sapiens
agagacctgggtttt

SEQ ID NO: 80349 - DNA, 15 bp, Homo sapiens
gagacctgggtttta

SEQ ID NO: 80350 - DNA, 15 bp, Homo sapiens
agacctgggttttag

SEQ ID NO: 80351 - DNA, 15 bp, Homo sapiens
gacctgggttttagc

SEQ ID NO: 80352 - DNA, 15 bp, Homo sapiens
acctgggttttagcc

SEQ ID NO: 80353 - DNA, 15 bp, Homo sapiens
cctgggttttagccc

SEQ ID NO: 80354 - DNA, 15 bp, Homo sapiens
ctgggttttagcccc

SEQ ID NO: 80355 - DNA, 15 bp, Homo sapiens
tgggttttagcccca

SEQ ID NO: 80356 - DNA, 15 bp, Homo sapiens
gggttttagccccag

SEQ ID NO: 80357 - DNA, 15 bp, Homo sapiens
ggttttagccccagc

SEQ ID NO: 80358 - DNA, 15 bp, Homo sapiens
gttttagccccagcc

SEQ ID NO: 80359 - DNA, 15 bp, Homo sapiens
ttttagccccagcct

SEQ ID NO: 80360 - DNA, 15 bp, Homo sapiens
tttagccccagcctg

SEQ ID NO: 80361 - DNA, 15 bp, Homo sapiens
ttagccccagcctga

SEQ ID NO: 80362 - DNA, 15 bp, Homo sapiens
tagccccagcctgac

SEQ ID NO: 80363 - DNA, 15 bp, Homo sapiens
agccccagcctgaca

SEQ ID NO: 80364 - DNA, 15 bp, Homo sapiens
gccccagcctgacag

SEQ ID NO: 80365 - DNA, 15 bp, Homo sapiens
ccccagcctgacagt

SEQ ID NO: 80366 - DNA, 15 bp, Homo sapiens
cccagcctgacagtg

SEQ ID NO: 80367 - DNA, 15 bp, Homo sapiens
ccagcctgacagtgg

SEQ ID NO: 80368 - DNA, 15 bp, Homo sapiens
cagcctgacagtggc

SEQ ID NO: 80369 - DNA, 15 bp, Homo sapiens
agcctgacagtggcc

SEQ ID NO: 80370 - DNA, 15 bp, Homo sapiens
gcctgacagtggcct

SEQ ID NO: 80371 - DNA, 15 bp, Homo sapiens
cctgacagtggcctt

SEQ ID NO: 80372 - DNA, 15 bp, Homo sapiens
ctgacagtggccttc

SEQ ID NO: 80373 - DNA, 15 bp, Homo sapiens
tgacagtggccttcc

SEQ ID NO: 80374 - DNA, 15 bp, Homo sapiens
gacagtggccttcca

SEQ ID NO: 80375 - DNA, 15 bp, Homo sapiens
acagtggccttccag

SEQ ID NO: 80376 - DNA, 15 bp, Homo sapiens
cagtggccttccagc

SEQ ID NO: 80377 - DNA, 15 bp, Homo sapiens
agtggccttccagca

SEQ ID NO: 80378 - DNA, 15 bp, Homo sapiens
gtggccttccagcaa

SEQ ID NO: 80379 - DNA, 15 bp, Homo sapiens
tggccttccagcaaa

SEQ ID NO: 80380 - DNA, 15 bp, Homo sapiens
ggccttccagcaaat

SEQ ID NO: 80381 - DNA, 15 bp, Homo sapiens
gccttccagcaaatt

SEQ ID NO: 80382 - DNA, 15 bp, Homo sapiens
ccttccagcaaattc

SEQ ID NO: 80383 - DNA, 15 bp, Homo sapiens
cttccagcaaattcc

SEQ ID NO: 80384 - DNA, 15 bp, Homo sapiens
ttccagcaaattcct

SEQ ID NO: 80385 - DNA, 15 bp, Homo sapiens
tccagcaaattcctg

SEQ ID NO: 80386 - DNA, 15 bp, Homo sapiens
ccagcaaattcctgc

SEQ ID NO: 80387 - DNA, 15 bp, Homo sapiens
cagcaaattcctgct

SEQ ID NO: 80388 - DNA, 15 bp, Homo sapiens
agcaaattcctgctc

SEQ ID NO: 80389 - DNA, 15 bp, Homo sapiens
gcaaattcctgctcc

SEQ ID NO: 80390 - DNA, 15 bp, Homo sapiens
caaattcctgctccc

SEQ ID NO: 80391 - DNA, 15 bp, Homo sapiens
aaattcctgctcccc

SEQ ID NO: 80392 - DNA, 15 bp, Homo sapiens
aattcctgctcccct

SEQ ID NO: 80393 - DNA, 15 bp, Homo sapiens
attcctgctcccctg

SEQ ID NO: 80394 - DNA, 15 bp, Homo sapiens
ttcctgctcccctgt

SEQ ID NO: 80395 - DNA, 15 bp, Homo sapiens
tcctgctcccctgtg

SEQ ID NO: 80396 - DNA, 15 bp, Homo sapiens
cctgctcccctgtgg

SEQ ID NO: 80397 - DNA, 15 bp, Homo sapiens
ctgctcccctgtggg

SEQ ID NO: 80398 - DNA, 15 bp, Homo sapiens
tgctcccctgtgggc

SEQ ID NO: 80399 - DNA, 15 bp, Homo sapiens
gctcccctgtgggcc

SEQ ID NO: 80400 - DNA, 15 bp, Homo sapiens
ctcccctgtgggcct

SEQ ID NO: 80401 - DNA, 15 bp, Homo sapiens
tcccctgtgggcctg

SEQ ID NO: 80402 - DNA, 15 bp, Homo sapiens
cccctgtgggcctgt

SEQ ID NO: 80403 - DNA, 15 bp, Homo sapiens
ccctgtgggcctgtt

SEQ ID NO: 80404 - DNA, 15 bp, Homo sapiens
cctgtgggcctgttt

SEQ ID NO: 80405 - DNA, 15 bp, Homo sapiens
ctgtgggcctgtttt

SEQ ID NO: 80406 - DNA, 15 bp, Homo sapiens
tgtgggcctgttttc

SEQ ID NO: 80407 - DNA, 15 bp, Homo sapiens
gtgggcctgttttcc

SEQ ID NO: 80408 - DNA, 15 bp, Homo sapiens
tgggcctgttttccc

SEQ ID NO: 80409 - DNA, 15 bp, Homo sapiens
gggcctgttttccca

SEQ ID NO: 80410 - DNA, 15 bp, Homo sapiens
ggcctgttttcccat

SEQ ID NO: 80411 - DNA, 15 bp, Homo sapiens
gcctgttttcccata

SEQ ID NO: 80412 - DNA, 15 bp, Homo sapiens
cctgttttcccatat

SEQ ID NO: 80413 - DNA, 15 bp, Homo sapiens
ctgttttcccatatg

SEQ ID NO: 80414 - DNA, 15 bp, Homo sapiens
tgttttcccatatgc

SEQ ID NO: 80415 - DNA, 15 bp, Homo sapiens
gttttcccatatgca

SEQ ID NO: 80416 - DNA, 15 bp, Homo sapiens
ttttcccatatgcaa

SEQ ID NO: 80417 - DNA, 15 bp, Homo sapiens
tttcccatatgcaaa

SEQ ID NO: 80418 - DNA, 15 bp, Homo sapiens
ttcccatatgcaaaa

SEQ ID NO: 80419 - DNA, 15 bp, Homo sapiens
tcccatatgcaaaac

SEQ ID NO: 80420 - DNA, 15 bp, Homo sapiens
cccatatgcaaaaca

SEQ ID NO: 80421 - DNA, 15 bp, Homo sapiens
ccatatgcaaaacag

SEQ ID NO: 80422 - DNA, 15 bp, Homo sapiens
catatgcaaaacaga

SEQ ID NO: 80423 - DNA, 15 bp, Homo sapiens
atatgcaaaacagac

SEQ ID NO: 80424 - DNA, 15 bp, Homo sapiens
tatgcaaaacagact

SEQ ID NO: 80425 - DNA, 15 bp, Homo sapiens
atgcaaaacagactt

SEQ ID NO: 80426 - DNA, 15 bp, Homo sapiens
tgcaaaacagacttc

SEQ ID NO: 80427 - DNA, 15 bp, Homo sapiens
gcaaaacagacttca

SEQ ID NO: 80428 - DNA, 15 bp, Homo sapiens
caaaacagacttcac

SEQ ID NO: 80429 - DNA, 15 bp, Homo sapiens
aaaacagacttcaca

SEQ ID NO: 80430 - DNA, 15 bp, Homo sapiens
aaacagacttcacag

SEQ ID NO: 80431 - DNA, 15 bp, Homo sapiens
aacagacttcacaga

SEQ ID NO: 80432 - DNA, 15 bp, Homo sapiens
acagacttcacagaa

SEQ ID NO: 80433 - DNA, 15 bp, Homo sapiens
cagacttcacagaat

SEQ ID NO: 80434 - DNA, 15 bp, Homo sapiens
agacttcacagaatg

SEQ ID NO: 80435 - DNA, 15 bp, Homo sapiens
gacttcacagaatgt

SEQ ID NO: 80436 - DNA, 15 bp, Homo sapiens
acttcacagaatgtg

SEQ ID NO: 80437 - DNA, 15 bp, Homo sapiens
cttcacagaatgtgc

SEQ ID NO: 80438 - DNA, 15 bp, Homo sapiens
ttcacagaatgtgct

SEQ ID NO: 80439 - DNA, 15 bp, Homo sapiens
tcacagaatgtgctc

SEQ ID NO: 80440 - DNA, 15 bp, Homo sapiens
cacagaatgtgctca

SEQ ID NO: 80441 - DNA, 15 bp, Homo sapiens
acagaatgtgctcag

SEQ ID NO: 80442 - DNA, 15 bp, Homo sapiens
cagaatgtgctcagc

SEQ ID NO: 80443 - DNA, 15 bp, Homo sapiens
agaatgtgctcagcc

SEQ ID NO: 80444 - DNA, 15 bp, Homo sapiens
gaatgtgctcagcca

SEQ ID NO: 80445 - DNA, 15 bp, Homo sapiens
aatgtgctcagccag

SEQ ID NO: 80446 - DNA, 15 bp, Homo sapiens
atgtgctcagccagt

SEQ ID NO: 80447 - DNA, 15 bp, Homo sapiens
tgtgctcagccagta

SEQ ID NO: 80448 - DNA, 15 bp, Homo sapiens
gtgctcagccagtaa

SEQ ID NO: 80449 - DNA, 15 bp, Homo sapiens
tgctcagccagtaat

SEQ ID NO: 80450 - DNA, 15 bp, Homo sapiens
gctcagccagtaatt

SEQ ID NO: 80451 - DNA, 15 bp, Homo sapiens
ctcagccagtaattg

SEQ ID NO: 80452 - DNA, 15 bp, Homo sapiens
tcagccagtaattgc

SEQ ID NO: 80453 - DNA, 15 bp, Homo sapiens
cagccagtaattgct

SEQ ID NO: 80454 - DNA, 15 bp, Homo sapiens
agccagtaattgctt

SEQ ID NO: 80455 - DNA, 15 bp, Homo sapiens
gccagtaattgcttc

SEQ ID NO: 80456 - DNA, 15 bp, Homo sapiens
ccagtaattgcttca

SEQ ID NO: 80457 - DNA, 15 bp, Homo sapiens
cagtaattgcttcac

SEQ ID NO: 80458 - DNA, 15 bp, Homo sapiens
agtaattgcttcact

SEQ ID NO: 80459 - DNA, 15 bp, Homo sapiens
gtaattgcttcactg

SEQ ID NO: 80460 - DNA, 15 bp, Homo sapiens
taattgcttcactgc

SEQ ID NO: 80461 - DNA, 15 bp, Homo sapiens
aattgcttcactgct

SEQ ID NO: 80462 - DNA, 15 bp, Homo sapiens
attgcttcactgctt

SEQ ID NO: 80463 - DNA, 15 bp, Homo sapiens
ttgcttcactgcttc

SEQ ID NO: 80464 - DNA, 15 bp, Homo sapiens
tgcttcactgcttct

SEQ ID NO: 80465 - DNA, 15 bp, Homo sapiens
gcttcactgcttctc

SEQ ID NO: 80466 - DNA, 15 bp, Homo sapiens
cttcactgcttctcc

SEQ ID NO: 80467 - DNA, 15 bp, Homo sapiens
ttcactgcttctcct

SEQ ID NO: 80468 - DNA, 15 bp, Homo sapiens
tcactgcttctcctc

SEQ ID NO: 80469 - DNA, 15 bp, Homo sapiens
cactgcttctcctct

SEQ ID NO: 80470 - DNA, 15 bp, Homo sapiens
actgcttctcctctt

SEQ ID NO: 80471 - DNA, 15 bp, Homo sapiens
ctgcttctcctcttg

SEQ ID NO: 80472 - DNA, 15 bp, Homo sapiens
tgcttctcctcttgt

SEQ ID NO: 80473 - DNA, 15 bp, Homo sapiens
gcttctcctcttgtt

SEQ ID NO: 80474 - DNA, 15 bp, Homo sapiens
cttctcctcttgttt

SEQ ID NO: 80475 - DNA, 15 bp, Homo sapiens
ttctcctcttgtttg

SEQ ID NO: 80476 - DNA, 15 bp, Homo sapiens
tctcctcttgtttgg

SEQ ID NO: 80477 - DNA, 15 bp, Homo sapiens
ctcctcttgtttggg

SEQ ID NO: 80478 - DNA, 15 bp, Homo sapiens
tcctcttgtttgggg

SEQ ID NO: 80479 - DNA, 15 bp, Homo sapiens
cctcttgtttggggc

SEQ ID NO: 80480 - DNA, 15 bp, Homo sapiens
ctcttgtttggggcg

SEQ ID NO: 80481 - DNA, 15 bp, Homo sapiens
tcttgtttggggcgg

SEQ ID NO: 80482 - DNA, 15 bp, Homo sapiens
cttgtttggggcggt

SEQ ID NO: 80483 - DNA, 15 bp, Homo sapiens
ttgtttggggcggtt

SEQ ID NO: 80484 - DNA, 15 bp, Homo sapiens
tgtttggggcggttc

SEQ ID NO: 80485 - DNA, 15 bp, Homo sapiens
gtttggggcggttcc

SEQ ID NO: 80486 - DNA, 15 bp, Homo sapiens
tttggggcggttcct

SEQ ID NO: 80487 - DNA, 15 bp, Homo sapiens
ttggggcggttcctg

SEQ ID NO: 80488 - DNA, 15 bp, Homo sapiens
tggggcggttcctgt

SEQ ID NO: 80489 - DNA, 15 bp, Homo sapiens
ggggcggttcctgtg

SEQ ID NO: 80490 - DNA, 15 bp, Homo sapiens
gggcggttcctgtgt

SEQ ID NO: 80491 - DNA, 15 bp, Homo sapiens
ggcggttcctgtgtg

SEQ ID NO: 80492 - DNA, 15 bp, Homo sapiens
gcggttcctgtgtgc

SEQ ID NO: 80493 - DNA, 15 bp, Homo sapiens
cggttcctgtgtgct

SEQ ID NO: 80494 - DNA, 15 bp, Homo sapiens
ggttcctgtgtgctg

SEQ ID NO: 80495 - DNA, 15 bp, Homo sapiens
gttcctgtgtgctgt

SEQ ID NO: 80496 - DNA, 15 bp, Homo sapiens
ttcctgtgtgctgtg

SEQ ID NO: 80497 - DNA, 15 bp, Homo sapiens
tcctgtgtgctgtgg

SEQ ID NO: 80498 - DNA, 15 bp, Homo sapiens
cctgtgtgctgtggg

SEQ ID NO: 80499 - DNA, 15 bp, Homo sapiens
ctgtgtgctgtgggg

SEQ ID NO: 80500 - DNA, 15 bp, Homo sapiens
tgtgtgctgtggggt

SEQ ID NO: 80501 - DNA, 15 bp, Homo sapiens
gtgtgctgtggggtc

SEQ ID NO: 80502 - DNA, 15 bp, Homo sapiens
tgtgctgtggggtct

SEQ ID NO: 80503 - DNA, 15 bp, Homo sapiens
gtgctgtggggtctc

SEQ ID NO: 80504 - DNA, 15 bp, Homo sapiens
tgctgtggggtctcc

SEQ ID NO: 80505 - DNA, 15 bp, Homo sapiens
gctgtggggtctccg

SEQ ID NO: 80506 - DNA, 15 bp, Homo sapiens
ctgtggggtctccgt

SEQ ID NO: 80507 - DNA, 15 bp, Homo sapiens
tgtggggtctccgtc

SEQ ID NO: 80508 - DNA, 15 bp, Homo sapiens
gtggggtctccgtca

SEQ ID NO: 80509 - DNA, 15 bp, Homo sapiens
tggggtctccgtcag

SEQ ID NO: 80510 - DNA, 15 bp, Homo sapiens
ggggtctccgtcagg

SEQ ID NO: 80511 - DNA, 15 bp, Homo sapiens
gggtctccgtcagga

SEQ ID NO: 80512 - DNA, 15 bp, Homo sapiens
ggtctccgtcaggat

SEQ ID NO: 80513 - DNA, 15 bp, Homo sapiens
gtctccgtcaggatt

SEQ ID NO: 80514 - DNA, 15 bp, Homo sapiens
tctccgtcaggattc

SEQ ID NO: 80515 - DNA, 15 bp, Homo sapiens
ctccgtcaggattca

SEQ ID NO: 80516 - DNA, 15 bp, Homo sapiens
tccgtcaggattcag

SEQ ID NO: 80517 - DNA, 15 bp, Homo sapiens
ccgtcaggattcagc

SEQ ID NO: 80518 - DNA, 15 bp, Homo sapiens
cgtcaggattcagcc

SEQ ID NO: 80519 - DNA, 15 bp, Homo sapiens
gtcaggattcagccc

SEQ ID NO: 80520 - DNA, 15 bp, Homo sapiens
tcaggattcagcccc

SEQ ID NO: 80521 - DNA, 15 bp, Homo sapiens
caggattcagccccg

SEQ ID NO: 80522 - DNA, 15 bp, Homo sapiens
aggattcagccccgc

SEQ ID NO: 80523 - DNA, 15 bp, Homo sapiens
ggattcagccccgct

SEQ ID NO: 80524 - DNA, 15 bp, Homo sapiens
gattcagccccgctg

SEQ ID NO: 80525 - DNA, 15 bp, Homo sapiens
attcagccccgctga

SEQ ID NO: 80526 - DNA, 15 bp, Homo sapiens
ttcagccccgctgag

SEQ ID NO: 80527 - DNA, 15 bp, Homo sapiens
tcagccccgctgaga

SEQ ID NO: 80528 - DNA, 15 bp, Homo sapiens
cagccccgctgagaa

SEQ ID NO: 80529 - DNA, 15 bp, Homo sapiens
agccccgctgagaac

SEQ ID NO: 80530 - DNA, 15 bp, Homo sapiens
gccccgctgagaacc

SEQ ID NO: 80531 - DNA, 15 bp, Homo sapiens
ccccgctgagaaccc

SEQ ID NO: 80532 - DNA, 15 bp, Homo sapiens
cccgctgagaaccca

SEQ ID NO: 80533 - DNA, 15 bp, Homo sapiens
ccgctgagaacccag

SEQ ID NO: 80534 - DNA, 15 bp, Homo sapiens
cgctgagaacccagg

SEQ ID NO: 80535 - DNA, 15 bp, Homo sapiens
gctgagaacccagga

SEQ ID NO: 80536 - DNA, 15 bp, Homo sapiens
ctgagaacccaggag

SEQ ID NO: 80537 - DNA, 15 bp, Homo sapiens
tgagaacccaggagc

SEQ ID NO: 80538 - DNA, 15 bp, Homo sapiens
gagaacccaggagcc

SEQ ID NO: 80539 - DNA, 15 bp, Homo sapiens
agaacccaggagccg

SEQ ID NO: 80540 - DNA, 15 bp, Homo sapiens
gaacccaggagccgg

SEQ ID NO: 80541 - DNA, 15 bp, Homo sapiens
aacccaggagccggg

SEQ ID NO: 80542 - DNA, 15 bp, Homo sapiens
acccaggagccgggc

SEQ ID NO: 80543 - DNA, 15 bp, Homo sapiens
cccaggagccgggct

SEQ ID NO: 80544 - DNA, 15 bp, Homo sapiens
ccaggagccgggctt

SEQ ID NO: 80545 - DNA, 15 bp, Homo sapiens
caggagccgggcttg

SEQ ID NO: 80546 - DNA, 15 bp, Homo sapiens
aggagccgggcttga

SEQ ID NO: 80547 - DNA, 15 bp, Homo sapiens
ggagccgggcttgag

SEQ ID NO: 80548 - DNA, 15 bp, Homo sapiens
gagccgggcttgagc

SEQ ID NO: 80549 - DNA, 15 bp, Homo sapiens
agccgggcttgagcc

SEQ ID NO: 80550 - DNA, 15 bp, Homo sapiens
gccgggcttgagccc

SEQ ID NO: 80551 - DNA, 15 bp, Homo sapiens
ccgggcttgagccct

SEQ ID NO: 80552 - DNA, 15 bp, Homo sapiens
cgggcttgagccctc

SEQ ID NO: 80553 - DNA, 15 bp, Homo sapiens
gggcttgagccctcc

SEQ ID NO: 80554 - DNA, 15 bp, Homo sapiens
ggcttgagccctcct

SEQ ID NO: 80555 - DNA, 15 bp, Homo sapiens
gcttgagccctcctt

SEQ ID NO: 80556 - DNA, 15 bp, Homo sapiens
cttgagccctccttc

SEQ ID NO: 80557 - DNA, 15 bp, Homo sapiens
ttgagccctccttcc

SEQ ID NO: 80558 - DNA, 15 bp, Homo sapiens
tgagccctccttcct

SEQ ID NO: 80559 - DNA, 15 bp, Homo sapiens
gagccctccttcctt

SEQ ID NO: 80560 - DNA, 15 bp, Homo sapiens
agccctccttccttt

SEQ ID NO: 80561 - DNA, 15 bp, Homo sapiens
gccctccttcctttc

SEQ ID NO: 80562 - DNA, 15 bp, Homo sapiens
ccctccttcctttcc

SEQ ID NO: 80563 - DNA, 15 bp, Homo sapiens
cctccttcctttccc

SEQ ID NO: 80564 - DNA, 15 bp, Homo sapiens
ctccttcctttccct

SEQ ID NO: 80565 - DNA, 15 bp, Homo sapiens
tccttcctttccctt

SEQ ID NO: 80566 - DNA, 15 bp, Homo sapiens
ccttcctttcccttc

SEQ ID NO: 80567 - DNA, 15 bp, Homo sapiens
cttcctttcccttcc

SEQ ID NO: 80568 - DNA, 15 bp, Homo sapiens
ttcctttcccttccc

SEQ ID NO: 80569 - DNA, 15 bp, Homo sapiens
tcctttcccttcccc

SEQ ID NO: 80570 - DNA, 15 bp, Homo sapiens
cctttcccttccccg

SEQ ID NO: 80571 - DNA, 15 bp, Homo sapiens
ctttcccttccccgt

SEQ ID NO: 80572 - DNA, 15 bp, Homo sapiens
tttcccttccccgtc

SEQ ID NO: 80573 - DNA, 15 bp, Homo sapiens
ttcccttccccgtcc

SEQ ID NO: 80574 - DNA, 15 bp, Homo sapiens
tcccttccccgtccg

SEQ ID NO: 80575 - DNA, 15 bp, Homo sapiens
cccttccccgtccgt

SEQ ID NO: 80576 - DNA, 15 bp, Homo sapiens
ccttccccgtccgtc

SEQ ID NO: 80577 - DNA, 15 bp, Homo sapiens
cttccccgtccgtcc

SEQ ID NO: 80578 - DNA, 15 bp, Homo sapiens
ttccccgtccgtcca

SEQ ID NO: 80579 - DNA, 15 bp, Homo sapiens
tccccgtccgtccat

SEQ ID NO: 80580 - DNA, 15 bp, Homo sapiens
ccccgtccgtccatc

SEQ ID NO: 80581 - DNA, 15 bp, Homo sapiens
cccgtccgtccatcc

SEQ ID NO: 80582 - DNA, 15 bp, Homo sapiens
ccgtccgtccatcca

SEQ ID NO: 80583 - DNA, 15 bp, Homo sapiens
cgtccgtccatccat

SEQ ID NO: 80584 - DNA, 15 bp, Homo sapiens
gtccgtccatccatg

SEQ ID NO: 80585 - DNA, 15 bp, Homo sapiens
tccgtccatccatgc

SEQ ID NO: 80586 - DNA, 15 bp, Homo sapiens
ccgtccatccatgca

SEQ ID NO: 80587 - DNA, 15 bp, Homo sapiens
cgtccatccatgcat

SEQ ID NO: 80588 - DNA, 15 bp, Homo sapiens
gtccatccatgcatc

SEQ ID NO: 80589 - DNA, 15 bp, Homo sapiens
tccatccatgcatcc

SEQ ID NO: 80590 - DNA, 15 bp, Homo sapiens
ccatccatgcatcct

SEQ ID NO: 80591 - DNA, 15 bp, Homo sapiens
catccatgcatcctg

SEQ ID NO: 80592 - DNA, 15 bp, Homo sapiens
atccatgcatcctgc

SEQ ID NO: 80593 - DNA, 15 bp, Homo sapiens
tccatgcatcctgct

SEQ ID NO: 80594 - DNA, 15 bp, Homo sapiens
ccatgcatcctgctg

SEQ ID NO: 80595 - DNA, 15 bp, Homo sapiens
catgcatcctgctga

SEQ ID NO: 80596 - DNA, 15 bp, Homo sapiens
atgcatcctgctgaa

SEQ ID NO: 80597 - DNA, 15 bp, Homo sapiens
tgcatcctgctgaag

SEQ ID NO: 80598 - DNA, 15 bp, Homo sapiens
gcatcctgctgaaga

SEQ ID NO: 80599 - DNA, 15 bp, Homo sapiens
catcctgctgaagaa

SEQ ID NO: 80600 - DNA, 15 bp, Homo sapiens
atcctgctgaagaag

SEQ ID NO: 80601 - DNA, 15 bp, Homo sapiens
tcctgctgaagaagc

SEQ ID NO: 80602 - DNA, 15 bp, Homo sapiens
cctgctgaagaagcg

SEQ ID NO: 80603 - DNA, 15 bp, Homo sapiens
ctgctgaagaagcgc

SEQ ID NO: 80604 - DNA, 15 bp, Homo sapiens
tgctgaagaagcgca

SEQ ID NO: 80605 - DNA, 15 bp, Homo sapiens
gctgaagaagcgcac

SEQ ID NO: 80606 - DNA, 15 bp, Homo sapiens
ctgaagaagcgcacc

SEQ ID NO: 80607 - DNA, 15 bp, Homo sapiens
tgaagaagcgcacca

SEQ ID NO: 80608 - DNA, 15 bp, Homo sapiens
gaagaagcgcaccag

SEQ ID NO: 80609 - DNA, 15 bp, Homo sapiens
aagaagcgcaccagg

SEQ ID NO: 80610 - DNA, 15 bp, Homo sapiens
agaagcgcaccaggc

SEQ ID NO: 80611 - DNA, 15 bp, Homo sapiens
gaagcgcaccaggct

SEQ ID NO: 80612 - DNA, 15 bp, Homo sapiens
aagcgcaccaggctc

SEQ ID NO: 80613 - DNA, 15 bp, Homo sapiens
agcgcaccaggctcc

SEQ ID NO: 80614 - DNA, 15 bp, Homo sapiens
gcgcaccaggctcct

SEQ ID NO: 80615 - DNA, 15 bp, Homo sapiens
cgcaccaggctcctt

SEQ ID NO: 80616 - DNA, 15 bp, Homo sapiens
gcaccaggctccttg

SEQ ID NO: 80617 - DNA, 15 bp, Homo sapiens
caccaggctccttgg

SEQ ID NO: 80618 - DNA, 15 bp, Homo sapiens
accaggctccttggg

SEQ ID NO: 80619 - DNA, 15 bp, Homo sapiens
ccaggctccttgggg

SEQ ID NO: 80620 - DNA, 15 bp, Homo sapiens
caggctccttggggg

SEQ ID NO: 80621 - DNA, 15 bp, Homo sapiens
aggctccttgggggt

SEQ ID NO: 80622 - DNA, 15 bp, Homo sapiens
ggctccttgggggtc

SEQ ID NO: 80623 - DNA, 15 bp, Homo sapiens
gctccttgggggtcc

SEQ ID NO: 80624 - DNA, 15 bp, Homo sapiens
ctccttgggggtcct

SEQ ID NO: 80625 - DNA, 15 bp, Homo sapiens
tccttgggggtcctt

SEQ ID NO: 80626 - DNA, 15 bp, Homo sapiens
ccttgggggtccttg

SEQ ID NO: 80627 - DNA, 15 bp, Homo sapiens
cttgggggtccttgg

SEQ ID NO: 80628 - DNA, 15 bp, Homo sapiens
ttgggggtccttgga

SEQ ID NO: 80629 - DNA, 15 bp, Homo sapiens
tgggggtccttggac

SEQ ID NO: 80630 - DNA, 15 bp, Homo sapiens
gggggtccttggact

SEQ ID NO: 80631 - DNA, 15 bp, Homo sapiens
ggggtccttggactt

SEQ ID NO: 80632 - DNA, 15 bp, Homo sapiens
gggtccttggacttc

SEQ ID NO: 80633 - DNA, 15 bp, Homo sapiens
ggtccttggacttcc

SEQ ID NO: 80634 - DNA, 15 bp, Homo sapiens
gtccttggacttccc

SEQ ID NO: 80635 - DNA, 15 bp, Homo sapiens
tccttggacttcccc

SEQ ID NO: 80636 - DNA, 15 bp, Homo sapiens
ccttggacttcccca

SEQ ID NO: 80637 - DNA, 15 bp, Homo sapiens
cttggacttccccac

SEQ ID NO: 80638 - DNA, 15 bp, Homo sapiens
ttggacttccccact

SEQ ID NO: 80639 - DNA, 15 bp, Homo sapiens
tggacttccccactt

SEQ ID NO: 80640 - DNA, 15 bp, Homo sapiens
ggacttccccacttg

SEQ ID NO: 80641 - DNA, 15 bp, Homo sapiens
gacttccccacttgc

SEQ ID NO: 80642 - DNA, 15 bp, Homo sapiens
acttccccacttgct

SEQ ID NO: 80643 - DNA, 15 bp, Homo sapiens
cttccccacttgctc

SEQ ID NO: 80644 - DNA, 15 bp, Homo sapiens
ttccccacttgctcc

SEQ ID NO: 80645 - DNA, 15 bp, Homo sapiens
tccccacttgctccc

SEQ ID NO: 80646 - DNA, 15 bp, Homo sapiens
ccccacttgctcccc

SEQ ID NO: 80647 - DNA, 15 bp, Homo sapiens
cccacttgctcccca

SEQ ID NO: 80648 - DNA, 15 bp, Homo sapiens
ccacttgctccccac

SEQ ID NO: 80649 - DNA, 15 bp, Homo sapiens
cacttgctccccacc

SEQ ID NO: 80650 - DNA, 15 bp, Homo sapiens
acttgctccccaccc

SEQ ID NO: 80651 - DNA, 15 bp, Homo sapiens
cttgctccccaccct

SEQ ID NO: 80652 - DNA, 15 bp, Homo sapiens
ttgctccccaccctg

SEQ ID NO: 80653 - DNA, 15 bp, Homo sapiens
tgctccccaccctgc

SEQ ID NO: 80654 - DNA, 15 bp, Homo sapiens
gctccccaccctgca

SEQ ID NO: 80655 - DNA, 15 bp, Homo sapiens
ctccccaccctgcag

SEQ ID NO: 80656 - DNA, 15 bp, Homo sapiens
tccccaccctgcagc

SEQ ID NO: 80657 - DNA, 15 bp, Homo sapiens
ccccaccctgcagcc

SEQ ID NO: 80658 - DNA, 15 bp, Homo sapiens
cccaccctgcagcca

SEQ ID NO: 80659 - DNA, 15 bp, Homo sapiens
ccaccctgcagccaa

SEQ ID NO: 80660 - DNA, 15 bp, Homo sapiens
caccctgcagccaaa

SEQ ID NO: 80661 - DNA, 15 bp, Homo sapiens
accctgcagccaaag

SEQ ID NO: 80662 - DNA, 15 bp, Homo sapiens
ccctgcagccaaagt

SEQ ID NO: 80663 - DNA, 15 bp, Homo sapiens
cctgcagccaaagtg

SEQ ID NO: 80664 - DNA, 15 bp, Homo sapiens
ctgcagccaaagtgc

SEQ ID NO: 80665 - DNA, 15 bp, Homo sapiens
tgcagccaaagtgct

SEQ ID NO: 80666 - DNA, 15 bp, Homo sapiens
gcagccaaagtgctc

SEQ ID NO: 80667 - DNA, 15 bp, Homo sapiens
cagccaaagtgctct

SEQ ID NO: 80668 - DNA, 15 bp, Homo sapiens
agccaaagtgctctt

SEQ ID NO: 80669 - DNA, 15 bp, Homo sapiens
gccaaagtgctcttt

SEQ ID NO: 80670 - DNA, 15 bp, Homo sapiens
ccaaagtgctctttt

SEQ ID NO: 80671 - DNA, 15 bp, Homo sapiens
caaagtgctcttttc

SEQ ID NO: 80672 - DNA, 15 bp, Homo sapiens
aaagtgctcttttca

SEQ ID NO: 80673 - DNA, 15 bp, Homo sapiens
aagtgctcttttcaa

SEQ ID NO: 80674 - DNA, 15 bp, Homo sapiens
agtgctcttttcaaa

SEQ ID NO: 80675 - DNA, 15 bp, Homo sapiens
gtgctcttttcaaag

SEQ ID NO: 80676 - DNA, 15 bp, Homo sapiens
tgctcttttcaaagg

SEQ ID NO: 80677 - DNA, 15 bp, Homo sapiens
gctcttttcaaaggc

SEQ ID NO: 80678 - DNA, 15 bp, Homo sapiens
ctcttttcaaaggcc

SEQ ID NO: 80679 - DNA, 15 bp, Homo sapiens
tcttttcaaaggccc

SEQ ID NO: 80680 - DNA, 15 bp, Homo sapiens
cttttcaaaggcccc

SEQ ID NO: 80681 - DNA, 15 bp, Homo sapiens
ttttcaaaggcccct

SEQ ID NO: 80682 - DNA, 15 bp, Homo sapiens
tttcaaaggcccctt

SEQ ID NO: 80683 - DNA, 15 bp, Homo sapiens
ttcaaaggccccttt

SEQ ID NO: 80684 - DNA, 15 bp, Homo sapiens
tcaaaggcccctttg

SEQ ID NO: 80685 - DNA, 15 bp, Homo sapiens
caaaggcccctttgc

SEQ ID NO: 80686 - DNA, 15 bp, Homo sapiens
aaaggcccctttgcc

SEQ ID NO: 80687 - DNA, 15 bp, Homo sapiens
aaggcccctttgcct

SEQ ID NO: 80688 - DNA, 15 bp, Homo sapiens
aggcccctttgcctt

SEQ ID NO: 80689 - DNA, 15 bp, Homo sapiens
ggcccctttgccttt

SEQ ID NO: 80690 - DNA, 15 bp, Homo sapiens
gcccctttgcctttt

SEQ ID NO: 80691 - DNA, 15 bp, Homo sapiens
cccctttgccttttc

SEQ ID NO: 80692 - DNA, 15 bp, Homo sapiens
ccctttgccttttct

SEQ ID NO: 80693 - DNA, 15 bp, Homo sapiens
cctttgccttttctc

SEQ ID NO: 80694 - DNA, 15 bp, Homo sapiens
ctttgccttttctct

SEQ ID NO: 80695 - DNA, 15 bp, Homo sapiens
tttgccttttctctg

SEQ ID NO: 80696 - DNA, 15 bp, Homo sapiens
ttgccttttctctgc

SEQ ID NO: 80697 - DNA, 15 bp, Homo sapiens
tgccttttctctgct

SEQ ID NO: 80698 - DNA, 15 bp, Homo sapiens
gccttttctctgctc

SEQ ID NO: 80699 - DNA, 15 bp, Homo sapiens
ccttttctctgctct

SEQ ID NO: 80700 - DNA, 15 bp, Homo sapiens
cttttctctgctctt

SEQ ID NO: 80701 - DNA, 15 bp, Homo sapiens
ttttctctgctcttg

SEQ ID NO: 80702 - DNA, 15 bp, Homo sapiens
tttctctgctcttgg

SEQ ID NO: 80703 - DNA, 15 bp, Homo sapiens
ttctctgctcttggg

SEQ ID NO: 80704 - DNA, 15 bp, Homo sapiens
tctctgctcttgggg

SEQ ID NO: 80705 - DNA, 15 bp, Homo sapiens
ctctgctcttggggt

SEQ ID NO: 80706 - DNA, 15 bp, Homo sapiens
tctgctcttggggtg

SEQ ID NO: 80707 - DNA, 15 bp, Homo sapiens
ctgctcttggggtga

SEQ ID NO: 80708 - DNA, 15 bp, Homo sapiens
tgctcttggggtgaa

SEQ ID NO: 80709 - DNA, 15 bp, Homo sapiens
gctcttggggtgaag

SEQ ID NO: 80710 - DNA, 15 bp, Homo sapiens
ctcttggggtgaagg

SEQ ID NO: 80711 - DNA, 15 bp, Homo sapiens
tcttggggtgaaggc

SEQ ID NO: 80712 - DNA, 15 bp, Homo sapiens
cttggggtgaaggcc

SEQ ID NO: 80713 - DNA, 15 bp, Homo sapiens
ttggggtgaaggccc

SEQ ID NO: 80714 - DNA, 15 bp, Homo sapiens
tggggtgaaggccca

SEQ ID NO: 80715 - DNA, 15 bp, Homo sapiens
ggggtgaaggcccag

SEQ ID NO: 80716 - DNA, 15 bp, Homo sapiens
gggtgaaggcccagt

SEQ ID NO: 80717 - DNA, 15 bp, Homo sapiens
ggtgaaggcccagtc

SEQ ID NO: 80718 - DNA, 15 bp, Homo sapiens
gtgaaggcccagtcc

SEQ ID NO: 80719 - DNA, 15 bp, Homo sapiens
tgaaggcccagtccc

SEQ ID NO: 80720 - DNA, 15 bp, Homo sapiens
gaaggcccagtccct

SEQ ID NO: 80721 - DNA, 15 bp, Homo sapiens
aaggcccagtccctt

SEQ ID NO: 80722 - DNA, 15 bp, Homo sapiens
aggcccagtccctta

SEQ ID NO: 80723 - DNA, 15 bp, Homo sapiens
ggcccagtcccttat

SEQ ID NO: 80724 - DNA, 15 bp, Homo sapiens
gcccagtcccttatg

SEQ ID NO: 80725 - DNA, 15 bp, Homo sapiens
cccagtcccttatgt

SEQ ID NO: 80726 - DNA, 15 bp, Homo sapiens
ccagtcccttatgtg

SEQ ID NO: 80727 - DNA, 15 bp, Homo sapiens
cagtcccttatgtgg

SEQ ID NO: 80728 - DNA, 15 bp, Homo sapiens
agtcccttatgtggt

SEQ ID NO: 80729 - DNA, 15 bp, Homo sapiens
gtcccttatgtggtt

SEQ ID NO: 80730 - DNA, 15 bp, Homo sapiens
tcccttatgtggttg

SEQ ID NO: 80731 - DNA, 15 bp, Homo sapiens
cccttatgtggttga

SEQ ID NO: 80732 - DNA, 15 bp, Homo sapiens
ccttatgtggttgac

SEQ ID NO: 80733 - DNA, 15 bp, Homo sapiens
cttatgtggttgacc

SEQ ID NO: 80734 - DNA, 15 bp, Homo sapiens
ttatgtggttgaccc

SEQ ID NO: 80735 - DNA, 15 bp, Homo sapiens
tatgtggttgacccc

SEQ ID NO: 80736 - DNA, 15 bp, Homo sapiens
atgtggttgaccccc

SEQ ID NO: 80737 - DNA, 15 bp, Homo sapiens
tgtggttgacccccc

SEQ ID NO: 80738 - DNA, 15 bp, Homo sapiens
gtggttgacccccca

SEQ ID NO: 80739 - DNA, 15 bp, Homo sapiens
tggttgaccccccaa

SEQ ID NO: 80740 - DNA, 15 bp, Homo sapiens
ggttgaccccccaac

SEQ ID NO: 80741 - DNA, 15 bp, Homo sapiens
gttgaccccccaacg

SEQ ID NO: 80742 - DNA, 15 bp, Homo sapiens
ttgaccccccaacgc

SEQ ID NO: 80743 - DNA, 15 bp, Homo sapiens
tgaccccccaacgcc

SEQ ID NO: 80744 - DNA, 15 bp, Homo sapiens
gaccccccaacgccc

SEQ ID NO: 80745 - DNA, 15 bp, Homo sapiens
accccccaacgcccc

SEQ ID NO: 80746 - DNA, 15 bp, Homo sapiens
ccccccaacgcccca

SEQ ID NO: 80747 - DNA, 15 bp, Homo sapiens
cccccaacgccccag

SEQ ID NO: 80748 - DNA, 15 bp, Homo sapiens
ccccaacgccccagg

SEQ ID NO: 80749 - DNA, 15 bp, Homo sapiens
cccaacgccccaggt

SEQ ID NO: 80750 - DNA, 15 bp, Homo sapiens
ccaacgccccaggtc

SEQ ID NO: 80751 - DNA, 15 bp, Homo sapiens
caacgccccaggtcc

SEQ ID NO: 80752 - DNA, 15 bp, Homo sapiens
aacgccccaggtccc

SEQ ID NO: 80753 - DNA, 15 bp, Homo sapiens
acgccccaggtccct

SEQ ID NO: 80754 - DNA, 15 bp, Homo sapiens
cgccccaggtccctg

SEQ ID NO: 80755 - DNA, 15 bp, Homo sapiens
gccccaggtccctgg

SEQ ID NO: 80756 - DNA, 15 bp, Homo sapiens
ccccaggtccctggg

SEQ ID NO: 80757 - DNA, 15 bp, Homo sapiens
cccaggtccctggga

SEQ ID NO: 80758 - DNA, 15 bp, Homo sapiens
ccaggtccctgggac

SEQ ID NO: 80759 - DNA, 15 bp, Homo sapiens
caggtccctgggact

SEQ ID NO: 80760 - DNA, 15 bp, Homo sapiens
aggtccctgggactc

SEQ ID NO: 80761 - DNA, 15 bp, Homo sapiens
ggtccctgggactcg

SEQ ID NO: 80762 - DNA, 15 bp, Homo sapiens
gtccctgggactcgg

SEQ ID NO: 80763 - DNA, 15 bp, Homo sapiens
tccctgggactcggg

SEQ ID NO: 80764 - DNA, 15 bp, Homo sapiens
ccctgggactcgggg

SEQ ID NO: 80765 - DNA, 15 bp, Homo sapiens
cctgggactcggggc

SEQ ID NO: 80766 - DNA, 15 bp, Homo sapiens
ctgggactcggggcg

SEQ ID NO: 80767 - DNA, 15 bp, Homo sapiens
tgggactcggggcgc

SEQ ID NO: 80768 - DNA, 15 bp, Homo sapiens
gggactcggggcgct

SEQ ID NO: 80769 - DNA, 15 bp, Homo sapiens
ggactcggggcgctc

SEQ ID NO: 80770 - DNA, 15 bp, Homo sapiens
gactcggggcgctcc

SEQ ID NO: 80771 - DNA, 15 bp, Homo sapiens
actcggggcgctccc

SEQ ID NO: 80772 - DNA, 15 bp, Homo sapiens
ctcggggcgctccct

SEQ ID NO: 80773 - DNA, 15 bp, Homo sapiens
tcggggcgctccctg

SEQ ID NO: 80774 - DNA, 15 bp, Homo sapiens
cggggcgctccctgc

SEQ ID NO: 80775 - DNA, 15 bp, Homo sapiens
ggggcgctccctgct

SEQ ID NO: 80776 - DNA, 15 bp, Homo sapiens
gggcgctccctgctg

SEQ ID NO: 80777 - DNA, 15 bp, Homo sapiens
ggcgctccctgctgc

SEQ ID NO: 80778 - DNA, 15 bp, Homo sapiens
gcgctccctgctgcc

SEQ ID NO: 80779 - DNA, 15 bp, Homo sapiens
cgctccctgctgcct

SEQ ID NO: 80780 - DNA, 15 bp, Homo sapiens
gctccctgctgcctg

SEQ ID NO: 80781 - DNA, 15 bp, Homo sapiens
ctccctgctgcctgc

SEQ ID NO: 80782 - DNA, 15 bp, Homo sapiens
tccctgctgcctgct

SEQ ID NO: 80783 - DNA, 15 bp, Homo sapiens
ccctgctgcctgctt

SEQ ID NO: 80784 - DNA, 15 bp, Homo sapiens
cctgctgcctgcttc

SEQ ID NO: 80785 - DNA, 15 bp, Homo sapiens
ctgctgcctgcttca

SEQ ID NO: 80786 - DNA, 15 bp, Homo sapiens
tgctgcctgcttcac

SEQ ID NO: 80787 - DNA, 15 bp, Homo sapiens
gctgcctgcttcaca

SEQ ID NO: 80788 - DNA, 15 bp, Homo sapiens
ctgcctgcttcacag

SEQ ID NO: 80789 - DNA, 15 bp, Homo sapiens
tgcctgcttcacagc

SEQ ID NO: 80790 - DNA, 15 bp, Homo sapiens
gcctgcttcacagcc

SEQ ID NO: 80791 - DNA, 15 bp, Homo sapiens
cctgcttcacagcct

SEQ ID NO: 80792 - DNA, 15 bp, Homo sapiens
ctgcttcacagcctt

SEQ ID NO: 80793 - DNA, 15 bp, Homo sapiens
tgcttcacagcctta

SEQ ID NO: 80794 - DNA, 15 bp, Homo sapiens
gcttcacagccttag

SEQ ID NO: 80795 - DNA, 15 bp, Homo sapiens
cttcacagccttagt

SEQ ID NO: 80796 - DNA, 15 bp, Homo sapiens
ttcacagccttagta

SEQ ID NO: 80797 - DNA, 15 bp, Homo sapiens
tcacagccttagtat

SEQ ID NO: 80798 - DNA, 15 bp, Homo sapiens
cacagccttagtatg

SEQ ID NO: 80799 - DNA, 15 bp, Homo sapiens
acagccttagtatgt

SEQ ID NO: 80800 - DNA, 15 bp, Homo sapiens
cagccttagtatgtg

SEQ ID NO: 80801 - DNA, 15 bp, Homo sapiens
agccttagtatgtgc

SEQ ID NO: 80802 - DNA, 15 bp, Homo sapiens
gccttagtatgtgcc

SEQ ID NO: 80803 - DNA, 15 bp, Homo sapiens
ccttagtatgtgccg

SEQ ID NO: 80804 - DNA, 15 bp, Homo sapiens
cttagtatgtgccgt

SEQ ID NO: 80805 - DNA, 15 bp, Homo sapiens
ttagtatgtgccgtt

SEQ ID NO: 80806 - DNA, 15 bp, Homo sapiens
tagtatgtgccgttc

SEQ ID NO: 80807 - DNA, 15 bp, Homo sapiens
agtatgtgccgttcg

SEQ ID NO: 80808 - DNA, 15 bp, Homo sapiens
gtatgtgccgttcgc

SEQ ID NO: 80809 - DNA, 15 bp, Homo sapiens
tatgtgccgttcgct

SEQ ID NO: 80810 - DNA, 15 bp, Homo sapiens
atgtgccgttcgctc

SEQ ID NO: 80811 - DNA, 15 bp, Homo sapiens
tgtgccgttcgctct

SEQ ID NO: 80812 - DNA, 15 bp, Homo sapiens
gtgccgttcgctctg

SEQ ID NO: 80813 - DNA, 15 bp, Homo sapiens
tgccgttcgctctgc

SEQ ID NO: 80814 - DNA, 15 bp, Homo sapiens
gccgttcgctctgcg

SEQ ID NO: 80815 - DNA, 15 bp, Homo sapiens
ccgttcgctctgcga

SEQ ID NO: 80816 - DNA, 15 bp, Homo sapiens
cgttcgctctgcgag

SEQ ID NO: 80817 - DNA, 15 bp, Homo sapiens
gttcgctctgcgaga

SEQ ID NO: 80818 - DNA, 15 bp, Homo sapiens
ttcgctctgcgagaa

SEQ ID NO: 80819 - DNA, 15 bp, Homo sapiens
tcgctctgcgagaaa

SEQ ID NO: 80820 - DNA, 15 bp, Homo sapiens
cgctctgcgagaaaa

SEQ ID NO: 80821 - DNA, 15 bp, Homo sapiens
gctctgcgagaaaag

SEQ ID NO: 80822 - DNA, 15 bp, Homo sapiens
ctctgcgagaaaagc

SEQ ID NO: 80823 - DNA, 15 bp, Homo sapiens
tctgcgagaaaagcc

SEQ ID NO: 80824 - DNA, 15 bp, Homo sapiens
ctgcgagaaaagcca

SEQ ID NO: 80825 - DNA, 15 bp, Homo sapiens
tgcgagaaaagccac

SEQ ID NO: 80826 - DNA, 15 bp, Homo sapiens
gcgagaaaagccacc

SEQ ID NO: 80827 - DNA, 15 bp, Homo sapiens
cgagaaaagccaccg

SEQ ID NO: 80828 - DNA, 15 bp, Homo sapiens
gagaaaagccaccgc

SEQ ID NO: 80829 - DNA, 15 bp, Homo sapiens
agaaaagccaccgcc

SEQ ID NO: 80830 - DNA, 15 bp, Homo sapiens
gaaaagccaccgccc

SEQ ID NO: 80831 - DNA, 15 bp, Homo sapiens
aaaagccaccgccca

SEQ ID NO: 80832 - DNA, 15 bp, Homo sapiens
aaagccaccgcccac

SEQ ID NO: 80833 - DNA, 15 bp, Homo sapiens
aagccaccgcccacc

SEQ ID NO: 80834 - DNA, 15 bp, Homo sapiens
agccaccgcccaccc

SEQ ID NO: 80835 - DNA, 15 bp, Homo sapiens
gccaccgcccaccca

SEQ ID NO: 80836 - DNA, 15 bp, Homo sapiens
ccaccgcccacccag

SEQ ID NO: 80837 - DNA, 15 bp, Homo sapiens
caccgcccacccagg

SEQ ID NO: 80838 - DNA, 15 bp, Homo sapiens
accgcccacccaggt

SEQ ID NO: 80839 - DNA, 15 bp, Homo sapiens
ccgcccacccaggtg

SEQ ID NO: 80840 - DNA, 15 bp, Homo sapiens
cgcccacccaggtgg

SEQ ID NO: 80841 - DNA, 15 bp, Homo sapiens
gcccacccaggtggt

SEQ ID NO: 80842 - DNA, 15 bp, Homo sapiens
cccacccaggtggtt

SEQ ID NO: 80843 - DNA, 15 bp, Homo sapiens
ccacccaggtggttc

SEQ ID NO: 80844 - DNA, 15 bp, Homo sapiens
cacccaggtggttcc

SEQ ID NO: 80845 - DNA, 15 bp, Homo sapiens
acccaggtggttcct

SEQ ID NO: 80846 - DNA, 15 bp, Homo sapiens
cccaggtggttcctc

SEQ ID NO: 80847 - DNA, 15 bp, Homo sapiens
ccaggtggttcctcc

SEQ ID NO: 80848 - DNA, 15 bp, Homo sapiens
caggtggttcctcct

SEQ ID NO: 80849 - DNA, 15 bp, Homo sapiens
aggtggttcctcctg

SEQ ID NO: 80850 - DNA, 15 bp, Homo sapiens
ggtggttcctcctgg

SEQ ID NO: 80851 - DNA, 15 bp, Homo sapiens
gtggttcctcctggt

SEQ ID NO: 80852 - DNA, 15 bp, Homo sapiens
tggttcctcctggtc

SEQ ID NO: 80853 - DNA, 15 bp, Homo sapiens
ggttcctcctggtct

SEQ ID NO: 80854 - DNA, 15 bp, Homo sapiens
gttcctcctggtctg

SEQ ID NO: 80855 - DNA, 15 bp, Homo sapiens
ttcctcctggtctgt

SEQ ID NO: 80856 - DNA, 15 bp, Homo sapiens
tcctcctggtctgtc

SEQ ID NO: 80857 - DNA, 15 bp, Homo sapiens
cctcctggtctgtct

SEQ ID NO: 80858 - DNA, 15 bp, Homo sapiens
ctcctggtctgtctg

SEQ ID NO: 80859 - DNA, 15 bp, Homo sapiens
tcctggtctgtctga

SEQ ID NO: 80860 - DNA, 15 bp, Homo sapiens
cctggtctgtctgat

SEQ ID NO: 80861 - DNA, 15 bp, Homo sapiens
ctggtctgtctgatt

SEQ ID NO: 80862 - DNA, 15 bp, Homo sapiens
tggtctgtctgattt

SEQ ID NO: 80863 - DNA, 15 bp, Homo sapiens
ggtctgtctgatttc

SEQ ID NO: 80864 - DNA, 15 bp, Homo sapiens
gtctgtctgatttca

SEQ ID NO: 80865 - DNA, 15 bp, Homo sapiens
tctgtctgatttcag

SEQ ID NO: 80866 - DNA, 15 bp, Homo sapiens
ctgtctgatttcaga

SEQ ID NO: 80867 - DNA, 15 bp, Homo sapiens
tgtctgatttcagaa

SEQ ID NO: 80868 - DNA, 15 bp, Homo sapiens
gtctgatttcagaac

SEQ ID NO: 80869 - DNA, 15 bp, Homo sapiens
tctgatttcagaact

SEQ ID NO: 80870 - DNA, 15 bp, Homo sapiens
ctgatttcagaactg

SEQ ID NO: 80871 - DNA, 15 bp, Homo sapiens
tgatttcagaactgg

SEQ ID NO: 80872 - DNA, 15 bp, Homo sapiens
gatttcagaactgga

SEQ ID NO: 80873 - DNA, 15 bp, Homo sapiens
atttcagaactggag

SEQ ID NO: 80874 - DNA, 15 bp, Homo sapiens
tttcagaactggaga

SEQ ID NO: 80875 - DNA, 15 bp, Homo sapiens
ttcagaactggagat

SEQ ID NO: 80876 - DNA, 15 bp, Homo sapiens
tcagaactggagatg

SEQ ID NO: 80877 - DNA, 15 bp, Homo sapiens
cagaactggagatgg

SEQ ID NO: 80878 - DNA, 15 bp, Homo sapiens
agaactggagatggc

SEQ ID NO: 80879 - DNA, 15 bp, Homo sapiens
gaactggagatggcc

SEQ ID NO: 80880 - DNA, 15 bp, Homo sapiens
aactggagatggcct

SEQ ID NO: 80881 - DNA, 15 bp, Homo sapiens
actggagatggcctc

SEQ ID NO: 80882 - DNA, 15 bp, Homo sapiens
ctggagatggcctcc

SEQ ID NO: 80883 - DNA, 15 bp, Homo sapiens
tggagatggcctccg

SEQ ID NO: 80884 - DNA, 15 bp, Homo sapiens
ggagatggcctccgg

SEQ ID NO: 80885 - DNA, 15 bp, Homo sapiens
gagatggcctccggt

SEQ ID NO: 80886 - DNA, 15 bp, Homo sapiens
agatggcctccggtc

SEQ ID NO: 80887 - DNA, 15 bp, Homo sapiens
gatggcctccggtcc

SEQ ID NO: 80888 - DNA, 15 bp, Homo sapiens
atggcctccggtcct

SEQ ID NO: 80889 - DNA, 15 bp, Homo sapiens
tggcctccggtcctg

SEQ ID NO: 80890 - DNA, 15 bp, Homo sapiens
ggcctccggtcctgt

SEQ ID NO: 80891 - DNA, 15 bp, Homo sapiens
gcctccggtcctgtt

SEQ ID NO: 80892 - DNA, 15 bp, Homo sapiens
cctccggtcctgttt

SEQ ID NO: 80893 - DNA, 15 bp, Homo sapiens
ctccggtcctgtttc

SEQ ID NO: 80894 - DNA, 15 bp, Homo sapiens
tccggtcctgtttcc

SEQ ID NO: 80895 - DNA, 15 bp, Homo sapiens
ccggtcctgtttcca

SEQ ID NO: 80896 - DNA, 15 bp, Homo sapiens
cggtcctgtttccac

SEQ ID NO: 80897 - DNA, 15 bp, Homo sapiens
ggtcctgtttccacc

SEQ ID NO: 80898 - DNA, 15 bp, Homo sapiens
gtcctgtttccaccc

SEQ ID NO: 80899 - DNA, 15 bp, Homo sapiens
tcctgtttccaccct

SEQ ID NO: 80900 - DNA, 15 bp, Homo sapiens
cctgtttccaccctg

SEQ ID NO: 80901 - DNA, 15 bp, Homo sapiens
ctgtttccaccctgg

SEQ ID NO: 80902 - DNA, 15 bp, Homo sapiens
tgtttccaccctggg

SEQ ID NO: 80903 - DNA, 15 bp, Homo sapiens
gtttccaccctgggg

SEQ ID NO: 80904 - DNA, 15 bp, Homo sapiens
tttccaccctggggg

SEQ ID NO: 80905 - DNA, 15 bp, Homo sapiens
ttccaccctgggggc

SEQ ID NO: 80906 - DNA, 15 bp, Homo sapiens
tccaccctgggggcg

SEQ ID NO: 80907 - DNA, 15 bp, Homo sapiens
ccaccctgggggcgc

SEQ ID NO: 80908 - DNA, 15 bp, Homo sapiens
caccctgggggcgcc

SEQ ID NO: 80909 - DNA, 15 bp, Homo sapiens
accctgggggcgcct

SEQ ID NO: 80910 - DNA, 15 bp, Homo sapiens
ccctgggggcgcctc

SEQ ID NO: 80911 - DNA, 15 bp, Homo sapiens
cctgggggcgcctct

SEQ ID NO: 80912 - DNA, 15 bp, Homo sapiens
ctgggggcgcctctc

SEQ ID NO: 80913 - DNA, 15 bp, Homo sapiens
tgggggcgcctctct

SEQ ID NO: 80914 - DNA, 15 bp, Homo sapiens
gggggcgcctctctg

SEQ ID NO: 80915 - DNA, 15 bp, Homo sapiens
ggggcgcctctctgc

SEQ ID NO: 80916 - DNA, 15 bp, Homo sapiens
gggcgcctctctgcg

SEQ ID NO: 80917 - DNA, 15 bp, Homo sapiens
ggcgcctctctgcgg

SEQ ID NO: 80918 - DNA, 15 bp, Homo sapiens
gcgcctctctgcggg

SEQ ID NO: 80919 - DNA, 15 bp, Homo sapiens
cgcctctctgcgggg

SEQ ID NO: 80920 - DNA, 15 bp, Homo sapiens
gcctctctgcggggc

SEQ ID NO: 80921 - DNA, 15 bp, Homo sapiens
cctctctgcggggcg

SEQ ID NO: 80922 - DNA, 15 bp, Homo sapiens
ctctctgcggggcgc

SEQ ID NO: 80923 - DNA, 15 bp, Homo sapiens
tctctgcggggcgcc

SEQ ID NO: 80924 - DNA, 15 bp, Homo sapiens
ctctgcggggcgcct

SEQ ID NO: 80925 - DNA, 15 bp, Homo sapiens
tctgcggggcgcctc

SEQ ID NO: 80926 - DNA, 15 bp, Homo sapiens
ctgcggggcgcctct

SEQ ID NO: 80927 - DNA, 15 bp, Homo sapiens
tgcggggcgcctctc

SEQ ID NO: 80928 - DNA, 15 bp, Homo sapiens
gcggggcgcctctct

SEQ ID NO: 80929 - DNA, 15 bp, Homo sapiens
cggggcgcctctctc

SEQ ID NO: 80930 - DNA, 15 bp, Homo sapiens
ggggcgcctctctct

SEQ ID NO: 80931 - DNA, 15 bp, Homo sapiens
gggcgcctctctctc

SEQ ID NO: 80932 - DNA, 15 bp, Homo sapiens
ggcgcctctctctct

SEQ ID NO: 80933 - DNA, 15 bp, Homo sapiens
gcgcctctctctctg

SEQ ID NO: 80934 - DNA, 15 bp, Homo sapiens
cgcctctctctctgg

SEQ ID NO: 80935 - DNA, 15 bp, Homo sapiens
gcctctctctctggg

SEQ ID NO: 80936 - DNA, 15 bp, Homo sapiens
cctctctctctgggg

SEQ ID NO: 80937 - DNA, 15 bp, Homo sapiens
ctctctctctggggt

SEQ ID NO: 80938 - DNA, 15 bp, Homo sapiens
tctctctctggggta

SEQ ID NO: 80939 - DNA, 15 bp, Homo sapiens
ctctctctggggtac

SEQ ID NO: 80940 - DNA, 15 bp, Homo sapiens
tctctctggggtacc

SEQ ID NO: 80941 - DNA, 15 bp, Homo sapiens
ctctctggggtacct

SEQ ID NO: 80942 - DNA, 15 bp, Homo sapiens
tctctggggtacctc

SEQ ID NO: 80943 - DNA, 15 bp, Homo sapiens
ctctggggtacctct

SEQ ID NO: 80944 - DNA, 15 bp, Homo sapiens
tctggggtacctctt

SEQ ID NO: 80945 - DNA, 15 bp, Homo sapiens
ctggggtacctcttt

SEQ ID NO: 80946 - DNA, 15 bp, Homo sapiens
tggggtacctctttg

SEQ ID NO: 80947 - DNA, 15 bp, Homo sapiens
ggggtacctctttgt

SEQ ID NO: 80948 - DNA, 15 bp, Homo sapiens
gggtacctctttgtc

SEQ ID NO: 80949 - DNA, 15 bp, Homo sapiens
ggtacctctttgtct

SEQ ID NO: 80950 - DNA, 15 bp, Homo sapiens
gtacctctttgtctg

SEQ ID NO: 80951 - DNA, 15 bp, Homo sapiens
tacctctttgtctgt

SEQ ID NO: 80952 - DNA, 15 bp, Homo sapiens
acctctttgtctgtg

SEQ ID NO: 80953 - DNA, 15 bp, Homo sapiens
cctctttgtctgtgg

SEQ ID NO: 80954 - DNA, 15 bp, Homo sapiens
ctctttgtctgtggg

SEQ ID NO: 80955 - DNA, 15 bp, Homo sapiens
tctttgtctgtgggg

SEQ ID NO: 80956 - DNA, 15 bp, Homo sapiens
ctttgtctgtggggc

SEQ ID NO: 80957 - DNA, 15 bp, Homo sapiens
tttgtctgtggggca

SEQ ID NO: 80958 - DNA, 15 bp, Homo sapiens
ttgtctgtggggcac

SEQ ID NO: 80959 - DNA, 15 bp, Homo sapiens
tgtctgtggggcacc

SEQ ID NO: 80960 - DNA, 15 bp, Homo sapiens
gtctgtggggcacct

SEQ ID NO: 80961 - DNA, 15 bp, Homo sapiens
tctgtggggcacctc

SEQ ID NO: 80962 - DNA, 15 bp, Homo sapiens
ctgtggggcacctct

SEQ ID NO: 80963 - DNA, 15 bp, Homo sapiens
tgtggggcacctctc

SEQ ID NO: 80964 - DNA, 15 bp, Homo sapiens
gtggggcacctctct

SEQ ID NO: 80965 - DNA, 15 bp, Homo sapiens
tggggcacctctctg

SEQ ID NO: 80966 - DNA, 15 bp, Homo sapiens
ggggcacctctctgt

SEQ ID NO: 80967 - DNA, 15 bp, Homo sapiens
gggcacctctctgtg

SEQ ID NO: 80968 - DNA, 15 bp, Homo sapiens
ggcacctctctgtgg

SEQ ID NO: 80969 - DNA, 15 bp, Homo sapiens
gcacctctctgtggg

SEQ ID NO: 80970 - DNA, 15 bp, Homo sapiens
cacctctctgtgggg

SEQ ID NO: 80971 - DNA, 15 bp, Homo sapiens
acctctctgtggggc

SEQ ID NO: 80972 - DNA, 15 bp, Homo sapiens
cctctctgtggggcg

SEQ ID NO: 80973 - DNA, 15 bp, Homo sapiens
ctctctgtggggcgc

SEQ ID NO: 80974 - DNA, 15 bp, Homo sapiens
tctctgtggggcgct

SEQ ID NO: 80975 - DNA, 15 bp, Homo sapiens
ctctgtggggcgctt

SEQ ID NO: 80976 - DNA, 15 bp, Homo sapiens
tctgtggggcgcttt

SEQ ID NO: 80977 - DNA, 15 bp, Homo sapiens
ctgtggggcgctttc

SEQ ID NO: 80978 - DNA, 15 bp, Homo sapiens
tgtggggcgctttcc

SEQ ID NO: 80979 - DNA, 15 bp, Homo sapiens
gtggggcgctttcct

SEQ ID NO: 80980 - DNA, 15 bp, Homo sapiens
tggggcgctttcctt

SEQ ID NO: 80981 - DNA, 15 bp, Homo sapiens
ggggcgctttccttc

SEQ ID NO: 80982 - DNA, 15 bp, Homo sapiens
gggcgctttccttct

SEQ ID NO: 80983 - DNA, 15 bp, Homo sapiens
ggcgctttccttctc

SEQ ID NO: 80984 - DNA, 15 bp, Homo sapiens
gcgctttccttctcg

SEQ ID NO: 80985 - DNA, 15 bp, Homo sapiens
cgctttccttctcgg

SEQ ID NO: 80986 - DNA, 15 bp, Homo sapiens
gctttccttctcggc

SEQ ID NO: 80987 - DNA, 15 bp, Homo sapiens
ctttccttctcggct

SEQ ID NO: 80988 - DNA, 15 bp, Homo sapiens
tttccttctcggctc

SEQ ID NO: 80989 - DNA, 15 bp, Homo sapiens
ttccttctcggctct

SEQ ID NO: 80990 - DNA, 15 bp, Homo sapiens
tccttctcggctctg

SEQ ID NO: 80991 - DNA, 15 bp, Homo sapiens
ccttctcggctctgc

SEQ ID NO: 80992 - DNA, 15 bp, Homo sapiens
cttctcggctctgcc

SEQ ID NO: 80993 - DNA, 15 bp, Homo sapiens
ttctcggctctgccc

SEQ ID NO: 80994 - DNA, 15 bp, Homo sapiens
tctcggctctgccct

SEQ ID NO: 80995 - DNA, 15 bp, Homo sapiens
ctcggctctgccctc

SEQ ID NO: 80996 - DNA, 15 bp, Homo sapiens
tcggctctgccctct

SEQ ID NO: 80997 - DNA, 15 bp, Homo sapiens
cggctctgccctctc

SEQ ID NO: 80998 - DNA, 15 bp, Homo sapiens
ggctctgccctctca

SEQ ID NO: 80999 - DNA, 15 bp, Homo sapiens
gctctgccctctcag

SEQ ID NO: 81000 - DNA, 15 bp, Homo sapiens
ctctgccctctcagg

SEQ ID NO: 81001 - DNA, 15 bp, Homo sapiens
tctgccctctcaggc

SEQ ID NO: 81002 - DNA, 15 bp, Homo sapiens
ctgccctctcaggct

SEQ ID NO: 81003 - DNA, 15 bp, Homo sapiens
tgccctctcaggcta

SEQ ID NO: 81004 - DNA, 15 bp, Homo sapiens
gccctctcaggctac

SEQ ID NO: 81005 - DNA, 15 bp, Homo sapiens
ccctctcaggctact

SEQ ID NO: 81006 - DNA, 15 bp, Homo sapiens
cctctcaggctactt

SEQ ID NO: 81007 - DNA, 15 bp, Homo sapiens
ctctcaggctacttc

SEQ ID NO: 81008 - DNA, 15 bp, Homo sapiens
tctcaggctacttcc

SEQ ID NO: 81009 - DNA, 15 bp, Homo sapiens
ctcaggctacttcct

SEQ ID NO: 81010 - DNA, 15 bp, Homo sapiens
tcaggctacttcctg

SEQ ID NO: 81011 - DNA, 15 bp, Homo sapiens
caggctacttcctgc

SEQ ID NO: 81012 - DNA, 15 bp, Homo sapiens
aggctacttcctgcc

SEQ ID NO: 81013 - DNA, 15 bp, Homo sapiens
ggctacttcctgcct

SEQ ID NO: 81014 - DNA, 15 bp, Homo sapiens
gctacttcctgcctt

SEQ ID NO: 81015 - DNA, 15 bp, Homo sapiens
ctacttcctgccttc

SEQ ID NO: 81016 - DNA, 15 bp, Homo sapiens
tacttcctgccttca

SEQ ID NO: 81017 - DNA, 15 bp, Homo sapiens
acttcctgccttcag

SEQ ID NO: 81018 - DNA, 15 bp, Homo sapiens
cttcctgccttcaga

SEQ ID NO: 81019 - DNA, 15 bp, Homo sapiens
ttcctgccttcagac

SEQ ID NO: 81020 - DNA, 15 bp, Homo sapiens
tcctgccttcagacc

SEQ ID NO: 81021 - DNA, 15 bp, Homo sapiens
cctgccttcagaccc

SEQ ID NO: 81022 - DNA, 15 bp, Homo sapiens
ctgccttcagacccc

SEQ ID NO: 81023 - DNA, 15 bp, Homo sapiens
tgccttcagacccca

SEQ ID NO: 81024 - DNA, 15 bp, Homo sapiens
gccttcagaccccag

SEQ ID NO: 81025 - DNA, 15 bp, Homo sapiens
ccttcagaccccagc

SEQ ID NO: 81026 - DNA, 15 bp, Homo sapiens
cttcagaccccagct

SEQ ID NO: 81027 - DNA, 15 bp, Homo sapiens
ttcagaccccagctc

SEQ ID NO: 81028 - DNA, 15 bp, Homo sapiens
tcagaccccagctcc

SEQ ID NO: 81029 - DNA, 15 bp, Homo sapiens
cagaccccagctcca

SEQ ID NO: 81030 - DNA, 15 bp, Homo sapiens
agaccccagctccat

SEQ ID NO: 81031 - DNA, 15 bp, Homo sapiens
gaccccagctccatg

SEQ ID NO: 81032 - DNA, 15 bp, Homo sapiens
accccagctccatgg

SEQ ID NO: 81033 - DNA, 15 bp, Homo sapiens
ccccagctccatggg

SEQ ID NO: 81034 - DNA, 15 bp, Homo sapiens
cccagctccatgggg

SEQ ID NO: 81035 - DNA, 15 bp, Homo sapiens
ccagctccatggggc

SEQ ID NO: 81036 - DNA, 15 bp, Homo sapiens
cagctccatggggct

SEQ ID NO: 81037 - DNA, 15 bp, Homo sapiens
agctccatggggctc

SEQ ID NO: 81038 - DNA, 15 bp, Homo sapiens
gctccatggggctct

SEQ ID NO: 81039 - DNA, 15 bp, Homo sapiens
ctccatggggctctc

SEQ ID NO: 81040 - DNA, 15 bp, Homo sapiens
tccatggggctctcc

SEQ ID NO: 81041 - DNA, 15 bp, Homo sapiens
ccatggggctctccc

SEQ ID NO: 81042 - DNA, 15 bp, Homo sapiens
catggggctctcccc

SEQ ID NO: 81043 - DNA, 15 bp, Homo sapiens
atggggctctccccc

SEQ ID NO: 81044 - DNA, 15 bp, Homo sapiens
tggggctctccccca

SEQ ID NO: 81045 - DNA, 15 bp, Homo sapiens
ggggctctcccccac

SEQ ID NO: 81046 - DNA, 15 bp, Homo sapiens
gggctctcccccacc

SEQ ID NO: 81047 - DNA, 15 bp, Homo sapiens
ggctctcccccacca

SEQ ID NO: 81048 - DNA, 15 bp, Homo sapiens
gctctcccccaccag

SEQ ID NO: 81049 - DNA, 15 bp, Homo sapiens
ctctcccccaccagg

SEQ ID NO: 81050 - DNA, 15 bp, Homo sapiens
tctcccccaccagga

SEQ ID NO: 81051 - DNA, 15 bp, Homo sapiens
ctcccccaccaggaa

SEQ ID NO: 81052 - DNA, 15 bp, Homo sapiens
tcccccaccaggaag

SEQ ID NO: 81053 - DNA, 15 bp, Homo sapiens
cccccaccaggaagt

SEQ ID NO: 81054 - DNA, 15 bp, Homo sapiens
ccccaccaggaagtc

SEQ ID NO: 81055 - DNA, 15 bp, Homo sapiens
cccaccaggaagtca

SEQ ID NO: 81056 - DNA, 15 bp, Homo sapiens
ccaccaggaagtcag

SEQ ID NO: 81057 - DNA, 15 bp, Homo sapiens
caccaggaagtcagc

SEQ ID NO: 81058 - DNA, 15 bp, Homo sapiens
accaggaagtcagct

SEQ ID NO: 81059 - DNA, 15 bp, Homo sapiens
ccaggaagtcagctc

SEQ ID NO: 81060 - DNA, 15 bp, Homo sapiens
caggaagtcagctct

SEQ ID NO: 81061 - DNA, 15 bp, Homo sapiens
aggaagtcagctctg

SEQ ID NO: 81062 - DNA, 15 bp, Homo sapiens
ggaagtcagctctgt

SEQ ID NO: 81063 - DNA, 15 bp, Homo sapiens
gaagtcagctctgtc

SEQ ID NO: 81064 - DNA, 15 bp, Homo sapiens
aagtcagctctgtca

SEQ ID NO: 81065 - DNA, 15 bp, Homo sapiens
agtcagctctgtcaa

SEQ ID NO: 81066 - DNA, 15 bp, Homo sapiens
gtcagctctgtcaaa

SEQ ID NO: 81067 - DNA, 15 bp, Homo sapiens
tcagctctgtcaaac

SEQ ID NO: 81068 - DNA, 15 bp, Homo sapiens
cagctctgtcaaacc

SEQ ID NO: 81069 - DNA, 15 bp, Homo sapiens
agctctgtcaaaccg

SEQ ID NO: 81070 - DNA, 15 bp, Homo sapiens
gctctgtcaaaccgg

SEQ ID NO: 81071 - DNA, 15 bp, Homo sapiens
ctctgtcaaaccggg

SEQ ID NO: 81072 - DNA, 15 bp, Homo sapiens
tctgtcaaaccgggt

SEQ ID NO: 81073 - DNA, 15 bp, Homo sapiens
ctgtcaaaccgggtc

SEQ ID NO: 81074 - DNA, 15 bp, Homo sapiens
tgtcaaaccgggtcc

SEQ ID NO: 81075 - DNA, 15 bp, Homo sapiens
gtcaaaccgggtccc

SEQ ID NO: 81076 - DNA, 15 bp, Homo sapiens
tcaaaccgggtccca

SEQ ID NO: 81077 - DNA, 15 bp, Homo sapiens
caaaccgggtcccag

SEQ ID NO: 81078 - DNA, 15 bp, Homo sapiens
aaaccgggtcccagg

SEQ ID NO: 81079 - DNA, 15 bp, Homo sapiens
aaccgggtcccaggg

SEQ ID NO: 81080 - DNA, 15 bp, Homo sapiens
accgggtcccagggt

SEQ ID NO: 81081 - DNA, 15 bp, Homo sapiens
ccgggtcccagggtt

SEQ ID NO: 81082 - DNA, 15 bp, Homo sapiens
cgggtcccagggttc

SEQ ID NO: 81083 - DNA, 15 bp, Homo sapiens
gggtcccagggttct

SEQ ID NO: 81084 - DNA, 15 bp, Homo sapiens
ggtcccagggttctg

SEQ ID NO: 81085 - DNA, 15 bp, Homo sapiens
gtcccagggttctgt

SEQ ID NO: 81086 - DNA, 15 bp, Homo sapiens
tcccagggttctgtt

SEQ ID NO: 81087 - DNA, 15 bp, Homo sapiens
cccagggttctgttt

SEQ ID NO: 81088 - DNA, 15 bp, Homo sapiens
ccagggttctgtttg

SEQ ID NO: 81089 - DNA, 15 bp, Homo sapiens
cagggttctgtttgt

SEQ ID NO: 81090 - DNA, 15 bp, Homo sapiens
agggttctgtttgtt

SEQ ID NO: 81091 - DNA, 15 bp, Homo sapiens
gggttctgtttgttc

SEQ ID NO: 81092 - DNA, 15 bp, Homo sapiens
ggttctgtttgttcc

SEQ ID NO: 81093 - DNA, 15 bp, Homo sapiens
gttctgtttgttcct

SEQ ID NO: 81094 - DNA, 15 bp, Homo sapiens
ttctgtttgttcctg

SEQ ID NO: 81095 - DNA, 15 bp, Homo sapiens
tctgtttgttcctgt

SEQ ID NO: 81096 - DNA, 15 bp, Homo sapiens
ctgtttgttcctgta

SEQ ID NO: 81097 - DNA, 15 bp, Homo sapiens
tgtttgttcctgtat

SEQ ID NO: 81098 - DNA, 15 bp, Homo sapiens
gtttgttcctgtatc

SEQ ID NO: 81099 - DNA, 15 bp, Homo sapiens
tttgttcctgtatcc

SEQ ID NO: 81100 - DNA, 15 bp, Homo sapiens
ttgttcctgtatccc

SEQ ID NO: 81101 - DNA, 15 bp, Homo sapiens
tgttcctgtatccct

SEQ ID NO: 81102 - DNA, 15 bp, Homo sapiens
gttcctgtatcccta

SEQ ID NO: 81103 - DNA, 15 bp, Homo sapiens
ttcctgtatccctag

SEQ ID NO: 81104 - DNA, 15 bp, Homo sapiens
tcctgtatccctagg

SEQ ID NO: 81105 - DNA, 15 bp, Homo sapiens
cctgtatccctaggg

SEQ ID NO: 81106 - DNA, 15 bp, Homo sapiens
ctgtatccctagggc

SEQ ID NO: 81107 - DNA, 15 bp, Homo sapiens
tgtatccctagggcc

SEQ ID NO: 81108 - DNA, 15 bp, Homo sapiens
gtatccctagggccc

SEQ ID NO: 81109 - DNA, 15 bp, Homo sapiens
tatccctagggccca

SEQ ID NO: 81110 - DNA, 15 bp, Homo sapiens
atccctagggcccag

SEQ ID NO: 81111 - DNA, 15 bp, Homo sapiens
tccctagggcccaga

SEQ ID NO: 81112 - DNA, 15 bp, Homo sapiens
ccctagggcccagag

SEQ ID NO: 81113 - DNA, 15 bp, Homo sapiens
cctagggcccagagc

SEQ ID NO: 81114 - DNA, 15 bp, Homo sapiens
ctagggcccagagca

SEQ ID NO: 81115 - DNA, 15 bp, Homo sapiens
tagggcccagagcac

SEQ ID NO: 81116 - DNA, 15 bp, Homo sapiens
agggcccagagcacc

SEQ ID NO: 81117 - DNA, 15 bp, Homo sapiens
gggcccagagcacca

SEQ ID NO: 81118 - DNA, 15 bp, Homo sapiens
ggcccagagcaccac

SEQ ID NO: 81119 - DNA, 15 bp, Homo sapiens
gcccagagcaccact

SEQ ID NO: 81120 - DNA, 15 bp, Homo sapiens
cccagagcaccactg

SEQ ID NO: 81121 - DNA, 15 bp, Homo sapiens
ccagagcaccactgg

SEQ ID NO: 81122 - DNA, 15 bp, Homo sapiens
cagagcaccactggc

SEQ ID NO: 81123 - DNA, 15 bp, Homo sapiens
agagcaccactggcc

SEQ ID NO: 81124 - DNA, 15 bp, Homo sapiens
gagcaccactggccc

SEQ ID NO: 81125 - DNA, 15 bp, Homo sapiens
agcaccactggccca

SEQ ID NO: 81126 - DNA, 15 bp, Homo sapiens
gcaccactggcccac

SEQ ID NO: 81127 - DNA, 15 bp, Homo sapiens
caccactggcccaca

SEQ ID NO: 81128 - DNA, 15 bp, Homo sapiens
accactggcccacag

SEQ ID NO: 81129 - DNA, 15 bp, Homo sapiens
ccactggcccacagt

SEQ ID NO: 81130 - DNA, 15 bp, Homo sapiens
cactggcccacagta

SEQ ID NO: 81131 - DNA, 15 bp, Homo sapiens
actggcccacagtag

SEQ ID NO: 81132 - DNA, 15 bp, Homo sapiens
ctggcccacagtagg

SEQ ID NO: 81133 - DNA, 15 bp, Homo sapiens
tggcccacagtaggt

SEQ ID NO: 81134 - DNA, 15 bp, Homo sapiens
ggcccacagtaggtg

SEQ ID NO: 81135 - DNA, 15 bp, Homo sapiens
gcccacagtaggtgt

SEQ ID NO: 81136 - DNA, 15 bp, Homo sapiens
cccacagtaggtgtt

SEQ ID NO: 81137 - DNA, 15 bp, Homo sapiens
ccacagtaggtgttt

SEQ ID NO: 81138 - DNA, 15 bp, Homo sapiens
cacagtaggtgttta

SEQ ID NO: 81139 - DNA, 15 bp, Homo sapiens
acagtaggtgtttaa

SEQ ID NO: 81140 - DNA, 15 bp, Homo sapiens
cagtaggtgtttaat

SEQ ID NO: 81141 - DNA, 15 bp, Homo sapiens
agtaggtgtttaata

SEQ ID NO: 81142 - DNA, 15 bp, Homo sapiens
gtaggtgtttaataa

SEQ ID NO: 81143 - DNA, 15 bp, Homo sapiens
taggtgtttaataaa

SEQ ID NO: 81144 - DNA, 15 bp, Homo sapiens
aggtgtttaataaat

SEQ ID NO: 81145 - DNA, 15 bp, Homo sapiens
ggtgtttaataaatc

SEQ ID NO: 81146 - DNA, 15 bp, Homo sapiens
gtgtttaataaatct

SEQ ID NO: 81147 - DNA, 15 bp, Homo sapiens
tgtttaataaatctc

SEQ ID NO: 81148 - DNA, 15 bp, Homo sapiens
gtttaataaatctct

SEQ ID NO: 81149 - DNA, 15 bp, Homo sapiens
tttaataaatctcta

SEQ ID NO: 81150 - DNA, 15 bp, Homo sapiens
ttaataaatctctag

SEQ ID NO: 81151 - DNA, 15 bp, Homo sapiens
taataaatctctaga

SEQ ID NO: 81152 - DNA, 15 bp, Homo sapiens
aataaatctctagaa

SEQ ID NO: 81153 - DNA, 15 bp, Homo sapiens
ataaatctctagaag

SEQ ID NO: 81154 - DNA, 15 bp, Homo sapiens
taaatctctagaagc

SEQ ID NO: 81155 - DNA, 15 bp, Homo sapiens
aaatctctagaagct

SEQ ID NO: 81156 - DNA, 15 bp, Homo sapiens
aatctctagaagcta

SEQ ID NO: 81157 - DNA, 15 bp, Homo sapiens
atctctagaagctac

SEQ ID NO: 81158 - DNA, 15 bp, Homo sapiens
tctctagaagctact

SEQ ID NO: 81159 - DNA, 15 bp, Homo sapiens
ctctagaagctactc

SEQ ID NO: 81160 - DNA, 15 bp, Homo sapiens
tctagaagctactcg

SEQ ID NO: 81161 - DNA, 15 bp, Homo sapiens
ctagaagctactcgg

SEQ ID NO: 81162 - DNA, 15 bp, Homo sapiens
tagaagctactcggg

SEQ ID NO: 81163 - DNA, 15 bp, Homo sapiens
agaagctactcggga

SEQ ID NO: 81164 - DNA, 15 bp, Homo sapiens
gaagctactcgggaa

SEQ ID NO: 81165 - DNA, 15 bp, Homo sapiens
aagctactcgggaat

SEQ ID NO: 81166 - DNA, 15 bp, Homo sapiens
agctactcgggaatc

SEQ ID NO: 81167 - DNA, 15 bp, Homo sapiens
gctactcgggaatct

SEQ ID NO: 81168 - DNA, 15 bp, Homo sapiens
ctactcgggaatctg

SEQ ID NO: 81169 - DNA, 15 bp, Homo sapiens
tactcgggaatctga

SEQ ID NO: 81170 - DNA, 15 bp, Homo sapiens
actcgggaatctgag

SEQ ID NO: 81171 - DNA, 15 bp, Homo sapiens
ctcgggaatctgagg

SEQ ID NO: 81172 - DNA, 15 bp, Homo sapiens
tcgggaatctgaggc

SEQ ID NO: 81173 - DNA, 15 bp, Homo sapiens
cgggaatctgaggca

SEQ ID NO: 81174 - DNA, 15 bp, Homo sapiens
gggaatctgaggcag

SEQ ID NO: 81175 - DNA, 15 bp, Homo sapiens
ggaatctgaggcagg

SEQ ID NO: 81176 - DNA, 15 bp, Homo sapiens
gaatctgaggcagga

SEQ ID NO: 81177 - DNA, 15 bp, Homo sapiens
aatctgaggcaggag

SEQ ID NO: 81178 - DNA, 15 bp, Homo sapiens
atctgaggcaggagg

SEQ ID NO: 81179 - DNA, 15 bp, Homo sapiens
tctgaggcaggagga

SEQ ID NO: 81180 - DNA, 15 bp, Homo sapiens
ggatcgcttgagcct

SEQ ID NO: 81181 - DNA, 15 bp, Homo sapiens
gatcgcttgagcctg

SEQ ID NO: 81182 - DNA, 15 bp, Homo sapiens
atcgcttgagcctgg

SEQ ID NO: 81183 - DNA, 15 bp, Homo sapiens
tcgcttgagcctggg

SEQ ID NO: 81184 - DNA, 15 bp, Homo sapiens
cgcttgagcctggga

SEQ ID NO: 81185 - DNA, 15 bp, Homo sapiens
tgagcctgggagttg

SEQ ID NO: 81186 - DNA, 15 bp, Homo sapiens
gagcctgggagttgg

SEQ ID NO: 81187 - DNA, 15 bp, Homo sapiens
agcctgggagttgga

SEQ ID NO: 81188 - DNA, 15 bp, Homo sapiens
gcctgggagttggag

SEQ ID NO: 81189 - DNA, 15 bp, Homo sapiens
cctgggagttggaga

SEQ ID NO: 81190 - DNA, 15 bp, Homo sapiens
ctgggagttggagac

SEQ ID NO: 81191 - DNA, 15 bp, Homo sapiens
tgggagttggagacc

SEQ ID NO: 81192 - DNA, 15 bp, Homo sapiens
gggagttggagacca

SEQ ID NO: 81193 - DNA, 15 bp, Homo sapiens
ggagttggagaccag

SEQ ID NO: 81194 - DNA, 15 bp, Homo sapiens
gagttggagaccagc

SEQ ID NO: 81195 - DNA, 15 bp, Homo sapiens
agttggagaccagcc

SEQ ID NO: 81196 - DNA, 15 bp, Homo sapiens
gttggagaccagcct

SEQ ID NO: 81197 - DNA, 15 bp, Homo sapiens
ttggagaccagcctg

SEQ ID NO: 81198 - DNA, 15 bp, Homo sapiens
tggagaccagcctgg

SEQ ID NO: 81199 - DNA, 15 bp, Homo sapiens
ggagaccagcctggg

SEQ ID NO: 81200 - DNA, 15 bp, Homo sapiens
gcaacatagcaagat

SEQ ID NO: 81201 - DNA, 15 bp, Homo sapiens
caacatagcaagata

SEQ ID NO: 81202 - DNA, 15 bp, Homo sapiens
aacatagcaagatag

SEQ ID NO: 81203 - DNA, 15 bp, Homo sapiens
acatagcaagatagg

SEQ ID NO: 81204 - DNA, 15 bp, Homo sapiens
catagcaagataggc

SEQ ID NO: 81205 - DNA, 15 bp, Homo sapiens
atagcaagataggca

SEQ ID NO: 81206 - DNA, 15 bp, Homo sapiens
tagcaagataggcat

SEQ ID NO: 81207 - DNA, 15 bp, Homo sapiens
agcaagataggcatg

SEQ ID NO: 81208 - DNA, 15 bp, Homo sapiens
gcaagataggcatgg

SEQ ID NO: 81209 - DNA, 15 bp, Homo sapiens
caagataggcatggt

SEQ ID NO: 81210 - DNA, 15 bp, Homo sapiens
aagataggcatggtg

SEQ ID NO: 81211 - DNA, 15 bp, Homo sapiens
agataggcatggtgg

SEQ ID NO: 81212 - DNA, 15 bp, Homo sapiens
gataggcatggtggt

SEQ ID NO: 81213 - DNA, 15 bp, Homo sapiens
ataggcatggtggta

SEQ ID NO: 81214 - DNA, 15 bp, Homo sapiens
taggcatggtggtac

SEQ ID NO: 81215 - DNA, 15 bp, Homo sapiens
aggcatggtggtaca

SEQ ID NO: 81216 - DNA, 15 bp, Homo sapiens
ggcatggtggtacac

SEQ ID NO: 81217 - DNA, 15 bp, Homo sapiens
gcatggtggtacaca

SEQ ID NO: 81218 - DNA, 15 bp, Homo sapiens
catggtggtacacac

SEQ ID NO: 81219 - DNA, 15 bp, Homo sapiens
atggtggtacacacc

SEQ ID NO: 81220 - DNA, 15 bp, Homo sapiens
tggtggtacacacct

SEQ ID NO: 81221 - DNA, 15 bp, Homo sapiens
ggtggtacacacctg

SEQ ID NO: 81222 - DNA, 15 bp, Homo sapiens
gtggtacacacctgt

SEQ ID NO: 81223 - DNA, 15 bp, Homo sapiens
tggtacacacctgta

SEQ ID NO: 81224 - DNA, 15 bp, Homo sapiens
ggtacacacctgtaa

SEQ ID NO: 81225 - DNA, 15 bp, Homo sapiens
gtacacacctgtaat

SEQ ID NO: 81226 - DNA, 15 bp, Homo sapiens
tacacacctgtaatc

SEQ ID NO: 81227 - DNA, 15 bp, Homo sapiens
ctgtaatcccagctg

SEQ ID NO: 81228 - DNA, 15 bp, Homo sapiens
tgtaatcccagctgc

SEQ ID NO: 81229 - DNA, 15 bp, Homo sapiens
gtaatcccagctgct

SEQ ID NO: 81230 - DNA, 15 bp, Homo sapiens
taatcccagctgctc

SEQ ID NO: 81231 - DNA, 15 bp, Homo sapiens
aatcccagctgctcg

SEQ ID NO: 81232 - DNA, 15 bp, Homo sapiens
atcccagctgctcgg

SEQ ID NO: 81233 - DNA, 15 bp, Homo sapiens
tcccagctgctcggg

SEQ ID NO: 81234 - DNA, 15 bp, Homo sapiens
cccagctgctcggga

SEQ ID NO: 81235 - DNA, 15 bp, Homo sapiens
ccagctgctcgggag

SEQ ID NO: 81236 - DNA, 15 bp, Homo sapiens
cagctgctcgggagg

SEQ ID NO: 81237 - DNA, 15 bp, Homo sapiens
agctgctcgggaggc

SEQ ID NO: 81238 - DNA, 15 bp, Homo sapiens
gctgctcgggaggcc

SEQ ID NO: 81239 - DNA, 15 bp, Homo sapiens
ctgctcgggaggccg

SEQ ID NO: 81240 - DNA, 15 bp, Homo sapiens
tgctcgggaggccga

SEQ ID NO: 81241 - DNA, 15 bp, Homo sapiens
gctcgggaggccgag

SEQ ID NO: 81242 - DNA, 15 bp, Homo sapiens
ctcgggaggccgagg

SEQ ID NO: 81243 - DNA, 15 bp, Homo sapiens
tcgggaggccgaggt

SEQ ID NO: 81244 - DNA, 15 bp, Homo sapiens
cgggaggccgaggtg

SEQ ID NO: 81245 - DNA, 15 bp, Homo sapiens
gaggccgaggtggga

SEQ ID NO: 81246 - DNA, 15 bp, Homo sapiens
aggccgaggtgggag

SEQ ID NO: 81247 - DNA, 15 bp, Homo sapiens
ggccgaggtgggagg

SEQ ID NO: 81248 - DNA, 15 bp, Homo sapiens
gccgaggtgggagga

SEQ ID NO: 81249 - DNA, 15 bp, Homo sapiens
ccgaggtgggaggat

SEQ ID NO: 81250 - DNA, 15 bp, Homo sapiens
cgaggtgggaggatc

SEQ ID NO: 81251 - DNA, 15 bp, Homo sapiens
ggtgggaggatcacg

SEQ ID NO: 81252 - DNA, 15 bp, Homo sapiens
gtgggaggatcacga

SEQ ID NO: 81253 - DNA, 15 bp, Homo sapiens
tgggaggatcacgag

SEQ ID NO: 81254 - DNA, 15 bp, Homo sapiens
gggaggatcacgagc

SEQ ID NO: 81255 - DNA, 15 bp, Homo sapiens
ggaggatcacgagcc

SEQ ID NO: 81256 - DNA, 15 bp, Homo sapiens
gaggatcacgagcct

SEQ ID NO: 81257 - DNA, 15 bp, Homo sapiens
aggatcacgagcctg

SEQ ID NO: 81258 - DNA, 15 bp, Homo sapiens
ggatcacgagcctgg

SEQ ID NO: 81259 - DNA, 15 bp, Homo sapiens
gatcacgagcctggg

SEQ ID NO: 81260 - DNA, 15 bp, Homo sapiens
atcacgagcctggga

SEQ ID NO: 81261 - DNA, 15 bp, Homo sapiens
tcacgagcctgggag

SEQ ID NO: 81262 - DNA, 15 bp, Homo sapiens
cacgagcctgggagg

SEQ ID NO: 81263 - DNA, 15 bp, Homo sapiens
acgagcctgggaggt

SEQ ID NO: 81264 - DNA, 15 bp, Homo sapiens
cgagcctgggaggtt

SEQ ID NO: 81265 - DNA, 15 bp, Homo sapiens
gagcctgggaggttg

SEQ ID NO: 81266 - DNA, 15 bp, Homo sapiens
agcctgggaggttga

SEQ ID NO: 81267 - DNA, 15 bp, Homo sapiens
gcctgggaggttgag

SEQ ID NO: 81268 - DNA, 15 bp, Homo sapiens
cctgggaggttgagg

SEQ ID NO: 81269 - DNA, 15 bp, Homo sapiens
ctgggaggttgaggc

SEQ ID NO: 81270 - DNA, 15 bp, Homo sapiens
tgggaggttgaggct

SEQ ID NO: 81271 - DNA, 15 bp, Homo sapiens
gggaggttgaggctg

SEQ ID NO: 81272 - DNA, 15 bp, Homo sapiens
aggttgaggctgcac

SEQ ID NO: 81273 - DNA, 15 bp, Homo sapiens
ggttgaggctgcact

SEQ ID NO: 81274 - DNA, 15 bp, Homo sapiens
gttgaggctgcactg

SEQ ID NO: 81275 - DNA, 15 bp, Homo sapiens
ttgaggctgcactga

SEQ ID NO: 81276 - DNA, 15 bp, Homo sapiens
tgaggctgcactgag

SEQ ID NO: 81277 - DNA, 15 bp, Homo sapiens
gaggctgcactgagc

SEQ ID NO: 81278 - DNA, 15 bp, Homo sapiens
aggctgcactgagcc

SEQ ID NO: 81279 - DNA, 15 bp, Homo sapiens
ggctgcactgagcca

SEQ ID NO: 81280 - DNA, 15 bp, Homo sapiens
gctgcactgagccat

SEQ ID NO: 81281 - DNA, 15 bp, Homo sapiens
ctgcactgagccatg

SEQ ID NO: 81282 - DNA, 15 bp, Homo sapiens
tgcactgagccatga

SEQ ID NO: 81283 - DNA, 15 bp, Homo sapiens
gcactgagccatgat

SEQ ID NO: 81284 - DNA, 15 bp, Homo sapiens
cactgagccatgatt

SEQ ID NO: 81285 - DNA, 15 bp, Homo sapiens
actgagccatgattg

SEQ ID NO: 81286 - DNA, 15 bp, Homo sapiens
ctgagccatgattgc

SEQ ID NO: 81287 - DNA, 15 bp, Homo sapiens
tgagccatgattgca

SEQ ID NO: 81288 - DNA, 15 bp, Homo sapiens
gagccatgattgcac

SEQ ID NO: 81289 - DNA, 15 bp, Homo sapiens
agccatgattgcacc

SEQ ID NO: 81290 - DNA, 15 bp, Homo sapiens
gccatgattgcacca

SEQ ID NO: 81291 - DNA, 15 bp, Homo sapiens
ccatgattgcaccac

SEQ ID NO: 81292 - DNA, 15 bp, Homo sapiens
catgattgcaccact

SEQ ID NO: 81293 - DNA, 15 bp, Homo sapiens
atgattgcaccactg

SEQ ID NO: 81294 - DNA, 15 bp, Homo sapiens
tgattgcaccactgc

SEQ ID NO: 81295 - DNA, 15 bp, Homo sapiens
ggtgacagaatgagt

SEQ ID NO: 81296 - DNA, 15 bp, Homo sapiens
gtgacagaatgagtc

SEQ ID NO: 81297 - DNA, 15 bp, Homo sapiens
tgacagaatgagtcc

SEQ ID NO: 81298 - DNA, 15 bp, Homo sapiens
gacagaatgagtccc

SEQ ID NO: 81299 - DNA, 15 bp, Homo sapiens
acagaatgagtccct

SEQ ID NO: 81300 - DNA, 15 bp, Homo sapiens
cagaatgagtccctg

SEQ ID NO: 81301 - DNA, 15 bp, Homo sapiens
agaatgagtccctgt

SEQ ID NO: 81302 - DNA, 15 bp, Homo sapiens
gaatgagtccctgtc

SEQ ID NO: 81303 - DNA, 15 bp, Homo sapiens
aatgagtccctgtct

SEQ ID NO: 81304 - DNA, 15 bp, Homo sapiens
atgagtccctgtctc

SEQ ID NO: 81305 - DNA, 15 bp, Homo sapiens
tgagtccctgtctca

SEQ ID NO: 81306 - DNA, 15 bp, Homo sapiens
gagtccctgtctcag

SEQ ID NO: 81307 - DNA, 15 bp, Homo sapiens
agtccctgtctcaga

SEQ ID NO: 81308 - DNA, 15 bp, Homo sapiens
gtccctgtctcagaa

SEQ ID NO: 81309 - DNA, 15 bp, Homo sapiens
tccctgtctcagaaa

SEQ ID NO: 81310 - DNA, 15 bp, Homo sapiens
ccctgtctcagaaaa

SEQ ID NO: 81311 - DNA, 15 bp, Homo sapiens
cctgtctcagaaaaa

SEQ ID NO: 81312 - DNA, 15 bp, Homo sapiens
ctgtctcagaaaaaa

SEQ ID NO: 81313 - DNA, 15 bp, Homo sapiens
tgtctcagaaaaaaa

SEQ ID NO: 81314 - DNA, 15 bp, Homo sapiens
gtctcagaaaaaaag

SEQ ID NO: 81315 - DNA, 15 bp, Homo sapiens
tctcagaaaaaaagt

SEQ ID NO: 81316 - DNA, 15 bp, Homo sapiens
ctcagaaaaaaagta

SEQ ID NO: 81317 - DNA, 15 bp, Homo sapiens
tcagaaaaaaagtaa

SEQ ID NO: 81318 - DNA, 15 bp, Homo sapiens
cagaaaaaaagtaag

SEQ ID NO: 81319 - DNA, 15 bp, Homo sapiens
agaaaaaaagtaagt

SEQ ID NO: 81320 - DNA, 15 bp, Homo sapiens
gaaaaaaagtaagtt

SEQ ID NO: 81321 - DNA, 15 bp, Homo sapiens
aaaaaaagtaagttg

SEQ ID NO: 81322 - DNA, 15 bp, Homo sapiens
aaaaaagtaagttgt

SEQ ID NO: 81323 - DNA, 15 bp, Homo sapiens
aaaaagtaagttgta

SEQ ID NO: 81324 - DNA, 15 bp, Homo sapiens
aaaagtaagttgtag

SEQ ID NO: 81325 - DNA, 15 bp, Homo sapiens
aaagtaagttgtaga

SEQ ID NO: 81326 - DNA, 15 bp, Homo sapiens
aagtaagttgtagaa

SEQ ID NO: 81327 - DNA, 15 bp, Homo sapiens
agtaagttgtagaaa

SEQ ID NO: 81328 - DNA, 15 bp, Homo sapiens
gtaagttgtagaaag

SEQ ID NO: 81329 - DNA, 15 bp, Homo sapiens
taagttgtagaaaga

SEQ ID NO: 81330 - DNA, 15 bp, Homo sapiens
aagttgtagaaagac

SEQ ID NO: 81331 - DNA, 15 bp, Homo sapiens
agttgtagaaagacc

SEQ ID NO: 81332 - DNA, 15 bp, Homo sapiens
gttgtagaaagacca

SEQ ID NO: 81333 - DNA, 15 bp, Homo sapiens
ttgtagaaagaccaa

SEQ ID NO: 81334 - DNA, 15 bp, Homo sapiens
tgtagaaagaccaag

SEQ ID NO: 81335 - DNA, 15 bp, Homo sapiens
gtagaaagaccaaga

SEQ ID NO: 81336 - DNA, 15 bp, Homo sapiens
tagaaagaccaagag

SEQ ID NO: 81337 - DNA, 15 bp, Homo sapiens
agaaagaccaagagc

SEQ ID NO: 81338 - DNA, 15 bp, Homo sapiens
gaaagaccaagagct

SEQ ID NO: 81339 - DNA, 15 bp, Homo sapiens
aaagaccaagagctg

SEQ ID NO: 81340 - DNA, 15 bp, Homo sapiens
aagaccaagagctgt

SEQ ID NO: 81341 - DNA, 15 bp, Homo sapiens
agaccaagagctgtg

SEQ ID NO: 81342 - DNA, 15 bp, Homo sapiens
gaccaagagctgtgg

SEQ ID NO: 81343 - DNA, 15 bp, Homo sapiens
accaagagctgtggc

SEQ ID NO: 81344 - DNA, 15 bp, Homo sapiens
ccaagagctgtggca

SEQ ID NO: 81345 - DNA, 15 bp, Homo sapiens
caagagctgtggcac

SEQ ID NO: 81346 - DNA, 15 bp, Homo sapiens
aagagctgtggcaca

SEQ ID NO: 81347 - DNA, 15 bp, Homo sapiens
agagctgtggcacag

SEQ ID NO: 81348 - DNA, 15 bp, Homo sapiens
gagctgtggcacagt

SEQ ID NO: 81349 - DNA, 15 bp, Homo sapiens
agctgtggcacagtg

SEQ ID NO: 81350 - DNA, 15 bp, Homo sapiens
gctgtggcacagtgt

SEQ ID NO: 81351 - DNA, 15 bp, Homo sapiens
ctgtggcacagtgtc

SEQ ID NO: 81352 - DNA, 15 bp, Homo sapiens
tgtggcacagtgtct

SEQ ID NO: 81353 - DNA, 15 bp, Homo sapiens
gtggcacagtgtctc

SEQ ID NO: 81354 - DNA, 15 bp, Homo sapiens
tggcacagtgtctca

SEQ ID NO: 81355 - DNA, 15 bp, Homo sapiens
ggcacagtgtctcac

SEQ ID NO: 81356 - DNA, 15 bp, Homo sapiens
gcacagtgtctcaca

SEQ ID NO: 81357 - DNA, 15 bp, Homo sapiens
cacagtgtctcacac

SEQ ID NO: 81358 - DNA, 15 bp, Homo sapiens
acagtgtctcacacc

SEQ ID NO: 81359 - DNA, 15 bp, Homo sapiens
cagtgtctcacacct

SEQ ID NO: 81360 - DNA, 15 bp, Homo sapiens
agtgtctcacacctg

SEQ ID NO: 81361 - DNA, 15 bp, Homo sapiens
gtgtctcacacctgt

SEQ ID NO: 81362 - DNA, 15 bp, Homo sapiens
tgtctcacacctgta

SEQ ID NO: 81363 - DNA, 15 bp, Homo sapiens
gtctcacacctgtaa

SEQ ID NO: 81364 - DNA, 15 bp, Homo sapiens
tctcacacctgtaac

SEQ ID NO: 81365 - DNA, 15 bp, Homo sapiens
ctcacacctgtaaca

SEQ ID NO: 81366 - DNA, 15 bp, Homo sapiens
tcacacctgtaacac

SEQ ID NO: 81367 - DNA, 15 bp, Homo sapiens
cacacctgtaacacc

SEQ ID NO: 81368 - DNA, 15 bp, Homo sapiens
acacctgtaacacca

SEQ ID NO: 81369 - DNA, 15 bp, Homo sapiens
cacctgtaacaccag

SEQ ID NO: 81370 - DNA, 15 bp, Homo sapiens
acctgtaacaccagc

SEQ ID NO: 81371 - DNA, 15 bp, Homo sapiens
cctgtaacaccagca

SEQ ID NO: 81372 - DNA, 15 bp, Homo sapiens
ctgtaacaccagcac

SEQ ID NO: 81373 - DNA, 15 bp, Homo sapiens
tgtaacaccagcact

SEQ ID NO: 81374 - DNA, 15 bp, Homo sapiens
gtaacaccagcactt

SEQ ID NO: 81375 - DNA, 15 bp, Homo sapiens
taacaccagcacttt

SEQ ID NO: 81376 - DNA, 15 bp, Homo sapiens
aacaccagcactttg

SEQ ID NO: 81377 - DNA, 15 bp, Homo sapiens
acaccagcactttgg

SEQ ID NO: 81378 - DNA, 15 bp, Homo sapiens
caccagcactttggg

SEQ ID NO: 81379 - DNA, 15 bp, Homo sapiens
ggctgaggcgggagg

SEQ ID NO: 81380 - DNA, 15 bp, Homo sapiens
gctgaggcgggagga

SEQ ID NO: 81381 - DNA, 15 bp, Homo sapiens
ctgaggcgggaggat

SEQ ID NO: 81382 - DNA, 15 bp, Homo sapiens
tgaggcgggaggatc

SEQ ID NO: 81383 - DNA, 15 bp, Homo sapiens
gaggcgggaggatca

SEQ ID NO: 81384 - DNA, 15 bp, Homo sapiens
aggcgggaggatcac

SEQ ID NO: 81385 - DNA, 15 bp, Homo sapiens
ggcgggaggatcact

SEQ ID NO: 81386 - DNA, 15 bp, Homo sapiens
gcgggaggatcactt

SEQ ID NO: 81387 - DNA, 15 bp, Homo sapiens
cgggaggatcacttg

SEQ ID NO: 81388 - DNA, 15 bp, Homo sapiens
gggaggatcacttga

SEQ ID NO: 81389 - DNA, 15 bp, Homo sapiens
ggatcacttgagcct

SEQ ID NO: 81390 - DNA, 15 bp, Homo sapiens
gatcacttgagccta

SEQ ID NO: 81391 - DNA, 15 bp, Homo sapiens
atcacttgagcctac

SEQ ID NO: 81392 - DNA, 15 bp, Homo sapiens
tcacttgagcctact

SEQ ID NO: 81393 - DNA, 15 bp, Homo sapiens
cacttgagcctactt

SEQ ID NO: 81394 - DNA, 15 bp, Homo sapiens
acttgagcctacttg

SEQ ID NO: 81395 - DNA, 15 bp, Homo sapiens
cttgagcctacttgg

SEQ ID NO: 81396 - DNA, 15 bp, Homo sapiens
ttgagcctacttgga

SEQ ID NO: 81397 - DNA, 15 bp, Homo sapiens
tgagcctacttggag

SEQ ID NO: 81398 - DNA, 15 bp, Homo sapiens
gagcctacttggaga

SEQ ID NO: 81399 - DNA, 15 bp, Homo sapiens
agcctacttggagac

SEQ ID NO: 81400 - DNA, 15 bp, Homo sapiens
gcctacttggagacc

SEQ ID NO: 81401 - DNA, 15 bp, Homo sapiens
cctacttggagacca

SEQ ID NO: 81402 - DNA, 15 bp, Homo sapiens
ctacttggagaccag

SEQ ID NO: 81403 - DNA, 15 bp, Homo sapiens
tacttggagaccagc

SEQ ID NO: 81404 - DNA, 15 bp, Homo sapiens
acttggagaccagcc

SEQ ID NO: 81405 - DNA, 15 bp, Homo sapiens
cttggagaccagcca

SEQ ID NO: 81406 - DNA, 15 bp, Homo sapiens
ttggagaccagccag

SEQ ID NO: 81407 - DNA, 15 bp, Homo sapiens
tggagaccagccagg

SEQ ID NO: 81408 - DNA, 15 bp, Homo sapiens
ggagaccagccaggc

SEQ ID NO: 81409 - DNA, 15 bp, Homo sapiens
gagaccagccaggcc

SEQ ID NO: 81410 - DNA, 15 bp, Homo sapiens
agaccagccaggcca

SEQ ID NO: 81411 - DNA, 15 bp, Homo sapiens
gaccagccaggccaa

SEQ ID NO: 81412 - DNA, 15 bp, Homo sapiens
accagccaggccaac

SEQ ID NO: 81413 - DNA, 15 bp, Homo sapiens
ccagccaggccaaca

SEQ ID NO: 81414 - DNA, 15 bp, Homo sapiens
cagccaggccaacaa

SEQ ID NO: 81415 - DNA, 15 bp, Homo sapiens
agccaggccaacaaa

SEQ ID NO: 81416 - DNA, 15 bp, Homo sapiens
gccaggccaacaaag

SEQ ID NO: 81417 - DNA, 15 bp, Homo sapiens
ccaggccaacaaagc

SEQ ID NO: 81418 - DNA, 15 bp, Homo sapiens
caggccaacaaagcg

SEQ ID NO: 81419 - DNA, 15 bp, Homo sapiens
aggccaacaaagcga

SEQ ID NO: 81420 - DNA, 15 bp, Homo sapiens
ggccaacaaagcgag

SEQ ID NO: 81421 - DNA, 15 bp, Homo sapiens
gccaacaaagcgaga

SEQ ID NO: 81422 - DNA, 15 bp, Homo sapiens
ccaacaaagcgagac

SEQ ID NO: 81423 - DNA, 15 bp, Homo sapiens
caacaaagcgagacc

SEQ ID NO: 81424 - DNA, 15 bp, Homo sapiens
aacaaagcgagaccc

SEQ ID NO: 81425 - DNA, 15 bp, Homo sapiens
acaaagcgagacccc

SEQ ID NO: 81426 - DNA, 15 bp, Homo sapiens
caaagcgagacccca

SEQ ID NO: 81427 - DNA, 15 bp, Homo sapiens
aaagcgagaccccat

SEQ ID NO: 81428 - DNA, 15 bp, Homo sapiens
aagcgagaccccatc

SEQ ID NO: 81429 - DNA, 15 bp, Homo sapiens
agcgagaccccatct

SEQ ID NO: 81430 - DNA, 15 bp, Homo sapiens
gcgagaccccatctc

SEQ ID NO: 81431 - DNA, 15 bp, Homo sapiens
cgagaccccatctct

SEQ ID NO: 81432 - DNA, 15 bp, Homo sapiens
gagaccccatctctt

SEQ ID NO: 81433 - DNA, 15 bp, Homo sapiens
agaccccatctcttt

SEQ ID NO: 81434 - DNA, 15 bp, Homo sapiens
gaccccatctctttt

SEQ ID NO: 81435 - DNA, 15 bp, Homo sapiens
accccatctcttttt

SEQ ID NO: 81436 - DNA, 15 bp, Homo sapiens
ccccatctctttttt

SEQ ID NO: 81437 - DNA, 15 bp, Homo sapiens
cccatctcttttttt

SEQ ID NO: 81438 - DNA, 15 bp, Homo sapiens
ccatctctttttttt

SEQ ID NO: 81439 - DNA, 15 bp, Homo sapiens
catctcttttttttt

SEQ ID NO: 81440 - DNA, 15 bp, Homo sapiens
atctctttttttttt

SEQ ID NO: 81441 - DNA, 15 bp, Homo sapiens
tctcttttttttttt

SEQ ID NO: 81442 - DNA, 15 bp, Homo sapiens
tttttttttttttat

SEQ ID NO: 81443 - DNA, 15 bp, Homo sapiens
ttttttttttttatc

SEQ ID NO: 81444 - DNA, 15 bp, Homo sapiens
tttttttttttatca

SEQ ID NO: 81445 - DNA, 15 bp, Homo sapiens
ttttttttttatcaa

SEQ ID NO: 81446 - DNA, 15 bp, Homo sapiens
tttttttttatcaaa

SEQ ID NO: 81447 - DNA, 15 bp, Homo sapiens
ttttttttatcaaaa

SEQ ID NO: 81448 - DNA, 15 bp, Homo sapiens
tttttttatcaaaac

SEQ ID NO: 81449 - DNA, 15 bp, Homo sapiens
ttttttatcaaaacc

SEQ ID NO: 81450 - DNA, 15 bp, Homo sapiens
tttttatcaaaaccc

SEQ ID NO: 81451 - DNA, 15 bp, Homo sapiens
ttttatcaaaaccca

SEQ ID NO: 81452 - DNA, 15 bp, Homo sapiens
tttatcaaaacccat

SEQ ID NO: 81453 - DNA, 15 bp, Homo sapiens
ttatcaaaacccata

SEQ ID NO: 81454 - DNA, 15 bp, Homo sapiens
tatcaaaacccatac

SEQ ID NO: 81455 - DNA, 15 bp, Homo sapiens
atcaaaacccatacg

SEQ ID NO: 81456 - DNA, 15 bp, Homo sapiens
tcaaaacccatacga

SEQ ID NO: 81457 - DNA, 15 bp, Homo sapiens
caaaacccatacgat

SEQ ID NO: 81458 - DNA, 15 bp, Homo sapiens
aaaacccatacgatt

SEQ ID NO: 81459 - DNA, 15 bp, Homo sapiens
aaacccatacgattg

SEQ ID NO: 81460 - DNA, 15 bp, Homo sapiens
aacccatacgattga

SEQ ID NO: 81461 - DNA, 15 bp, Homo sapiens
acccatacgattgag

SEQ ID NO: 81462 - DNA, 15 bp, Homo sapiens
cccatacgattgagt

SEQ ID NO: 81463 - DNA, 15 bp, Homo sapiens
ccatacgattgagtg

SEQ ID NO: 81464 - DNA, 15 bp, Homo sapiens
catacgattgagtga

SEQ ID NO: 81465 - DNA, 15 bp, Homo sapiens
atacgattgagtgac

SEQ ID NO: 81466 - DNA, 15 bp, Homo sapiens
tacgattgagtgaca

SEQ ID NO: 81467 - DNA, 15 bp, Homo sapiens
acgattgagtgacaa

SEQ ID NO: 81468 - DNA, 15 bp, Homo sapiens
cgattgagtgacaag

SEQ ID NO: 81469 - DNA, 15 bp, Homo sapiens
gattgagtgacaagg

SEQ ID NO: 81470 - DNA, 15 bp, Homo sapiens
attgagtgacaagga

SEQ ID NO: 81471 - DNA, 15 bp, Homo sapiens
ttgagtgacaaggac

SEQ ID NO: 81472 - DNA, 15 bp, Homo sapiens
tgagtgacaaggacc

SEQ ID NO: 81473 - DNA, 15 bp, Homo sapiens
gagtgacaaggacct

SEQ ID NO: 81474 - DNA, 15 bp, Homo sapiens
agtgacaaggacctg

SEQ ID NO: 81475 - DNA, 15 bp, Homo sapiens
gtgacaaggacctga

SEQ ID NO: 81476 - DNA, 15 bp, Homo sapiens
tgacaaggacctgag

SEQ ID NO: 81477 - DNA, 15 bp, Homo sapiens
gacaaggacctgagg

SEQ ID NO: 81478 - DNA, 15 bp, Homo sapiens
acaaggacctgagga

SEQ ID NO: 81479 - DNA, 15 bp, Homo sapiens
caaggacctgaggac

SEQ ID NO: 81480 - DNA, 15 bp, Homo sapiens
aaggacctgaggact

SEQ ID NO: 81481 - DNA, 15 bp, Homo sapiens
aggacctgaggactg

SEQ ID NO: 81482 - DNA, 15 bp, Homo sapiens
ggacctgaggactgc

SEQ ID NO: 81483 - DNA, 15 bp, Homo sapiens
gacctgaggactgca

SEQ ID NO: 81484 - DNA, 15 bp, Homo sapiens
acctgaggactgcag

SEQ ID NO: 81485 - DNA, 15 bp, Homo sapiens
cctgaggactgcagc

SEQ ID NO: 81486 - DNA, 15 bp, Homo sapiens
ctgaggactgcagct

SEQ ID NO: 81487 - DNA, 15 bp, Homo sapiens
tgaggactgcagctg

SEQ ID NO: 81488 - DNA, 15 bp, Homo sapiens
gaggactgcagctgc

SEQ ID NO: 81489 - DNA, 15 bp, Homo sapiens
aggactgcagctgca

SEQ ID NO: 81490 - DNA, 15 bp, Homo sapiens
ggactgcagctgcag

SEQ ID NO: 81491 - DNA, 15 bp, Homo sapiens
gactgcagctgcagg

SEQ ID NO: 81492 - DNA, 15 bp, Homo sapiens
actgcagctgcaggt

SEQ ID NO: 81493 - DNA, 15 bp, Homo sapiens
ctgcagctgcaggtg

SEQ ID NO: 81494 - DNA, 15 bp, Homo sapiens
tgcagctgcaggtgt

SEQ ID NO: 81495 - DNA, 15 bp, Homo sapiens
gcagctgcaggtgtg

SEQ ID NO: 81496 - DNA, 15 bp, Homo sapiens
cagctgcaggtgtgg

SEQ ID NO: 81497 - DNA, 15 bp, Homo sapiens
agctgcaggtgtggc

SEQ ID NO: 81498 - DNA, 15 bp, Homo sapiens
gctgcaggtgtggcc

SEQ ID NO: 81499 - DNA, 15 bp, Homo sapiens
ctgcaggtgtggcca

SEQ ID NO: 81500 - DNA, 15 bp, Homo sapiens
tgcaggtgtggccac

SEQ ID NO: 81501 - DNA, 15 bp, Homo sapiens
gcaggtgtggccacc

SEQ ID NO: 81502 - DNA, 15 bp, Homo sapiens
caggtgtggccacct

SEQ ID NO: 81503 - DNA, 15 bp, Homo sapiens
aggtgtggccacctg

SEQ ID NO: 81504 - DNA, 15 bp, Homo sapiens
ggtgtggccacctgg

SEQ ID NO: 81505 - DNA, 15 bp, Homo sapiens
gtgtggccacctggt

SEQ ID NO: 81506 - DNA, 15 bp, Homo sapiens
tgtggccacctggta

SEQ ID NO: 81507 - DNA, 15 bp, Homo sapiens
gtggccacctggtag

SEQ ID NO: 81508 - DNA, 15 bp, Homo sapiens
tggccacctggtagc

SEQ ID NO: 81509 - DNA, 15 bp, Homo sapiens
ggccacctggtagcc

SEQ ID NO: 81510 - DNA, 15 bp, Homo sapiens
gccacctggtagcca

SEQ ID NO: 81511 - DNA, 15 bp, Homo sapiens
ccacctggtagccat

SEQ ID NO: 81512 - DNA, 15 bp, Homo sapiens
cacctggtagccata

SEQ ID NO: 81513 - DNA, 15 bp, Homo sapiens
acctggtagccatac

SEQ ID NO: 81514 - DNA, 15 bp, Homo sapiens
cctggtagccatact

SEQ ID NO: 81515 - DNA, 15 bp, Homo sapiens
ctggtagccatactg

SEQ ID NO: 81516 - DNA, 15 bp, Homo sapiens
tggtagccatactga

SEQ ID NO: 81517 - DNA, 15 bp, Homo sapiens
ggtagccatactgac

SEQ ID NO: 81518 - DNA, 15 bp, Homo sapiens
gtagccatactgaca

SEQ ID NO: 81519 - DNA, 15 bp, Homo sapiens
tagccatactgacag

SEQ ID NO: 81520 - DNA, 15 bp, Homo sapiens
agccatactgacagt

SEQ ID NO: 81521 - DNA, 15 bp, Homo sapiens
gccatactgacagta

SEQ ID NO: 81522 - DNA, 15 bp, Homo sapiens
ccatactgacagtat

SEQ ID NO: 81523 - DNA, 15 bp, Homo sapiens
catactgacagtatt

SEQ ID NO: 81524 - DNA, 15 bp, Homo sapiens
atactgacagtattt

SEQ ID NO: 81525 - DNA, 15 bp, Homo sapiens
tactgacagtattta

SEQ ID NO: 81526 - DNA, 15 bp, Homo sapiens
actgacagtatttat

SEQ ID NO: 81527 - DNA, 15 bp, Homo sapiens
ctgacagtatttatc

SEQ ID NO: 81528 - DNA, 15 bp, Homo sapiens
tgacagtatttatcc

SEQ ID NO: 81529 - DNA, 15 bp, Homo sapiens
gacagtatttatccc

SEQ ID NO: 81530 - DNA, 15 bp, Homo sapiens
acagtatttatccca

SEQ ID NO: 81531 - DNA, 15 bp, Homo sapiens
cagtatttatcccac

SEQ ID NO: 81532 - DNA, 15 bp, Homo sapiens
agtatttatcccaca

SEQ ID NO: 81533 - DNA, 15 bp, Homo sapiens
gtatttatcccacag

SEQ ID NO: 81534 - DNA, 15 bp, Homo sapiens
tatttatcccacaga

SEQ ID NO: 81535 - DNA, 15 bp, Homo sapiens
atttatcccacagaa

SEQ ID NO: 81536 - DNA, 15 bp, Homo sapiens
tttatcccacagaaa

SEQ ID NO: 81537 - DNA, 15 bp, Homo sapiens
ttatcccacagaaag

SEQ ID NO: 81538 - DNA, 15 bp, Homo sapiens
tatcccacagaaaga

SEQ ID NO: 81539 - DNA, 15 bp, Homo sapiens
atcccacagaaagac

SEQ ID NO: 81540 - DNA, 15 bp, Homo sapiens
tcccacagaaagacc

SEQ ID NO: 81541 - DNA, 15 bp, Homo sapiens
cccacagaaagacct

SEQ ID NO: 81542 - DNA, 15 bp, Homo sapiens
ccacagaaagacctg

SEQ ID NO: 81543 - DNA, 15 bp, Homo sapiens
cacagaaagacctgg

SEQ ID NO: 81544 - DNA, 15 bp, Homo sapiens
acagaaagacctggt

SEQ ID NO: 81545 - DNA, 15 bp, Homo sapiens
cagaaagacctggtg

SEQ ID NO: 81546 - DNA, 15 bp, Homo sapiens
agaaagacctggtgg

SEQ ID NO: 81547 - DNA, 15 bp, Homo sapiens
gaaagacctggtgga

SEQ ID NO: 81548 - DNA, 15 bp, Homo sapiens
aaagacctggtggaa

SEQ ID NO: 81549 - DNA, 15 bp, Homo sapiens
aagacctggtggaag

SEQ ID NO: 81550 - DNA, 15 bp, Homo sapiens
agacctggtggaaga

SEQ ID NO: 81551 - DNA, 15 bp, Homo sapiens
gacctggtggaagag

SEQ ID NO: 81552 - DNA, 15 bp, Homo sapiens
acctggtggaagagg

SEQ ID NO: 81553 - DNA, 15 bp, Homo sapiens
cctggtggaagagga

SEQ ID NO: 81554 - DNA, 15 bp, Homo sapiens
ctggtggaagaggag

SEQ ID NO: 81555 - DNA, 15 bp, Homo sapiens
tggtggaagaggagg

SEQ ID NO: 81556 - DNA, 15 bp, Homo sapiens
ggtggaagaggaggc

SEQ ID NO: 81557 - DNA, 15 bp, Homo sapiens
gtggaagaggaggct

SEQ ID NO: 81558 - DNA, 15 bp, Homo sapiens
tggaagaggaggctg

SEQ ID NO: 81559 - DNA, 15 bp, Homo sapiens
ggaagaggaggctga

SEQ ID NO: 81560 - DNA, 15 bp, Homo sapiens
gaagaggaggctgag

SEQ ID NO: 81561 - DNA, 15 bp, Homo sapiens
aagaggaggctgagg

SEQ ID NO: 81562 - DNA, 15 bp, Homo sapiens
agaggaggctgagga

SEQ ID NO: 81563 - DNA, 15 bp, Homo sapiens
gaggaggctgaggag

SEQ ID NO: 81564 - DNA, 15 bp, Homo sapiens
aggaggctgaggagg

SEQ ID NO: 81565 - DNA, 15 bp, Homo sapiens
ggaggctgaggaggc

SEQ ID NO: 81566 - DNA, 15 bp, Homo sapiens
gaggctgaggaggct

SEQ ID NO: 81567 - DNA, 15 bp, Homo sapiens
aggctgaggaggctg

SEQ ID NO: 81568 - DNA, 15 bp, Homo sapiens
ggctgaggaggctgg

SEQ ID NO: 81569 - DNA, 15 bp, Homo sapiens
gctgaggaggctgga

SEQ ID NO: 81570 - DNA, 15 bp, Homo sapiens
ctgaggaggctggag

SEQ ID NO: 81571 - DNA, 15 bp, Homo sapiens
tgaggaggctggagt

SEQ ID NO: 81572 - DNA, 15 bp, Homo sapiens
gaggaggctggagtg

SEQ ID NO: 81573 - DNA, 15 bp, Homo sapiens
aggaggctggagtgg

SEQ ID NO: 81574 - DNA, 15 bp, Homo sapiens
ggaggctggagtggc

SEQ ID NO: 81575 - DNA, 15 bp, Homo sapiens
gaggctggagtggct

SEQ ID NO: 81576 - DNA, 15 bp, Homo sapiens
aggctggagtggctt

SEQ ID NO: 81577 - DNA, 15 bp, Homo sapiens
ggctggagtggcttt

SEQ ID NO: 81578 - DNA, 15 bp, Homo sapiens
gctggagtggctttg

SEQ ID NO: 81579 - DNA, 15 bp, Homo sapiens
ctggagtggctttga

SEQ ID NO: 81580 - DNA, 15 bp, Homo sapiens
tggagtggctttgag

SEQ ID NO: 81581 - DNA, 15 bp, Homo sapiens
ggagtggctttgaga

SEQ ID NO: 81582 - DNA, 15 bp, Homo sapiens
gagtggctttgagaa

SEQ ID NO: 81583 - DNA, 15 bp, Homo sapiens
agtggctttgagaag

SEQ ID NO: 81584 - DNA, 15 bp, Homo sapiens
gtggctttgagaagc

SEQ ID NO: 81585 - DNA, 15 bp, Homo sapiens
tggctttgagaagca

SEQ ID NO: 81586 - DNA, 15 bp, Homo sapiens
ggctttgagaagcac

SEQ ID NO: 81587 - DNA, 15 bp, Homo sapiens
gctttgagaagcacc

SEQ ID NO: 81588 - DNA, 15 bp, Homo sapiens
ctttgagaagcaccc

SEQ ID NO: 81589 - DNA, 15 bp, Homo sapiens
tttgagaagcaccca

SEQ ID NO: 81590 - DNA, 15 bp, Homo sapiens
ttgagaagcacccag

SEQ ID NO: 81591 - DNA, 15 bp, Homo sapiens
tgagaagcacccaga

SEQ ID NO: 81592 - DNA, 15 bp, Homo sapiens
gagaagcacccagag

SEQ ID NO: 81593 - DNA, 15 bp, Homo sapiens
agaagcacccagagc

SEQ ID NO: 81594 - DNA, 15 bp, Homo sapiens
gaagcacccagagca

SEQ ID NO: 81595 - DNA, 15 bp, Homo sapiens
aagcacccagagcac

SEQ ID NO: 81596 - DNA, 15 bp, Homo sapiens
agcacccagagcaca

SEQ ID NO: 81597 - DNA, 15 bp, Homo sapiens
gcacccagagcacac

SEQ ID NO: 81598 - DNA, 15 bp, Homo sapiens
cacccagagcacact

SEQ ID NO: 81599 - DNA, 15 bp, Homo sapiens
acccagagcacactg

SEQ ID NO: 81600 - DNA, 15 bp, Homo sapiens
cccagagcacactgc

SEQ ID NO: 81601 - DNA, 15 bp, Homo sapiens
ccagagcacactgca

SEQ ID NO: 81602 - DNA, 15 bp, Homo sapiens
cagagcacactgcaa

SEQ ID NO: 81603 - DNA, 15 bp, Homo sapiens
agagcacactgcaag

SEQ ID NO: 81604 - DNA, 15 bp, Homo sapiens
gagcacactgcaagc

SEQ ID NO: 81605 - DNA, 15 bp, Homo sapiens
agcacactgcaagca

SEQ ID NO: 81606 - DNA, 15 bp, Homo sapiens
gcacactgcaagcag

SEQ ID NO: 81607 - DNA, 15 bp, Homo sapiens
cacactgcaagcagg

SEQ ID NO: 81608 - DNA, 15 bp, Homo sapiens
acactgcaagcaggt

SEQ ID NO: 81609 - DNA, 15 bp, Homo sapiens
cactgcaagcaggtc

SEQ ID NO: 81610 - DNA, 15 bp, Homo sapiens
actgcaagcaggtct

SEQ ID NO: 81611 - DNA, 15 bp, Homo sapiens
ctgcaagcaggtctg

SEQ ID NO: 81612 - DNA, 15 bp, Homo sapiens
tgcaagcaggtctgg

SEQ ID NO: 81613 - DNA, 15 bp, Homo sapiens
gcaagcaggtctggc

SEQ ID NO: 81614 - DNA, 15 bp, Homo sapiens
caagcaggtctggct

SEQ ID NO: 81615 - DNA, 15 bp, Homo sapiens
aagcaggtctggctg

SEQ ID NO: 81616 - DNA, 15 bp, Homo sapiens
agcaggtctggctgc

SEQ ID NO: 81617 - DNA, 15 bp, Homo sapiens
gcaggtctggctgca

SEQ ID NO: 81618 - DNA, 15 bp, Homo sapiens
caggtctggctgcag

SEQ ID NO: 81619 - DNA, 15 bp, Homo sapiens
aggtctggctgcaga

SEQ ID NO: 81620 - DNA, 15 bp, Homo sapiens
ggtctggctgcagat

SEQ ID NO: 81621 - DNA, 15 bp, Homo sapiens
gtctggctgcagatg

SEQ ID NO: 81622 - DNA, 15 bp, Homo sapiens
tctggctgcagatgc

SEQ ID NO: 81623 - DNA, 15 bp, Homo sapiens
ctggctgcagatgcc

SEQ ID NO: 81624 - DNA, 15 bp, Homo sapiens
tggctgcagatgcct

SEQ ID NO: 81625 - DNA, 15 bp, Homo sapiens
ggctgcagatgcctg

SEQ ID NO: 81626 - DNA, 15 bp, Homo sapiens
gctgcagatgcctgg

SEQ ID NO: 81627 - DNA, 15 bp, Homo sapiens
ctgcagatgcctggg

SEQ ID NO: 81628 - DNA, 15 bp, Homo sapiens
tgcagatgcctgggc

SEQ ID NO: 81629 - DNA, 15 bp, Homo sapiens
gcagatgcctgggct

SEQ ID NO: 81630 - DNA, 15 bp, Homo sapiens
cagatgcctgggctg

SEQ ID NO: 81631 - DNA, 15 bp, Homo sapiens
agatgcctgggctgc

SEQ ID NO: 81632 - DNA, 15 bp, Homo sapiens
gatgcctgggctgct

SEQ ID NO: 81633 - DNA, 15 bp, Homo sapiens
atgcctgggctgctc

SEQ ID NO: 81634 - DNA, 15 bp, Homo sapiens
tgcctgggctgctcc

SEQ ID NO: 81635 - DNA, 15 bp, Homo sapiens
gcctgggctgctccc

SEQ ID NO: 81636 - DNA, 15 bp, Homo sapiens
cctgggctgctccca

SEQ ID NO: 81637 - DNA, 15 bp, Homo sapiens
ctgggctgctcccat

SEQ ID NO: 81638 - DNA, 15 bp, Homo sapiens
tgggctgctcccatc

SEQ ID NO: 81639 - DNA, 15 bp, Homo sapiens
gggctgctcccatcg

SEQ ID NO: 81640 - DNA, 15 bp, Homo sapiens
ggctgctcccatcgc

SEQ ID NO: 81641 - DNA, 15 bp, Homo sapiens
gctgctcccatcgcc

SEQ ID NO: 81642 - DNA, 15 bp, Homo sapiens
ctgctcccatcgcca

SEQ ID NO: 81643 - DNA, 15 bp, Homo sapiens
tgctcccatcgccat

SEQ ID NO: 81644 - DNA, 15 bp, Homo sapiens
gctcccatcgccatg

SEQ ID NO: 81645 - DNA, 15 bp, Homo sapiens
ctcccatcgccatgc

SEQ ID NO: 81646 - DNA, 15 bp, Homo sapiens
tcccatcgccatgca

SEQ ID NO: 81647 - DNA, 15 bp, Homo sapiens
cccatcgccatgcag

SEQ ID NO: 81648 - DNA, 15 bp, Homo sapiens
ccatcgccatgcaga

SEQ ID NO: 81649 - DNA, 15 bp, Homo sapiens
catcgccatgcagat

SEQ ID NO: 81650 - DNA, 15 bp, Homo sapiens
atcgccatgcagatc

SEQ ID NO: 81651 - DNA, 15 bp, Homo sapiens
tcgccatgcagatct

SEQ ID NO: 81652 - DNA, 15 bp, Homo sapiens
cgccatgcagatcta

SEQ ID NO: 81653 - DNA, 15 bp, Homo sapiens
gccatgcagatctac

SEQ ID NO: 81654 - DNA, 15 bp, Homo sapiens
ccatgcagatctaca

SEQ ID NO: 81655 - DNA, 15 bp, Homo sapiens
catgcagatctacaa

SEQ ID NO: 81656 - DNA, 15 bp, Homo sapiens
atgcagatctacaag

SEQ ID NO: 81657 - DNA, 15 bp, Homo sapiens
tgcagatctacaaga

SEQ ID NO: 81658 - DNA, 15 bp, Homo sapiens
gcagatctacaagaa

SEQ ID NO: 81659 - DNA, 15 bp, Homo sapiens
cagatctacaagaag

SEQ ID NO: 81660 - DNA, 15 bp, Homo sapiens
agatctacaagaagc

SEQ ID NO: 81661 - DNA, 15 bp, Homo sapiens
gatctacaagaagca

SEQ ID NO: 81662 - DNA, 15 bp, Homo sapiens
atctacaagaagcac

SEQ ID NO: 81663 - DNA, 15 bp, Homo sapiens
tctacaagaagcacc

SEQ ID NO: 81664 - DNA, 15 bp, Homo sapiens
ctacaagaagcacct

SEQ ID NO: 81665 - DNA, 15 bp, Homo sapiens
tacaagaagcacctg

SEQ ID NO: 81666 - DNA, 15 bp, Homo sapiens
acaagaagcacctgg

SEQ ID NO: 81667 - DNA, 15 bp, Homo sapiens
caagaagcacctgga

SEQ ID NO: 81668 - DNA, 15 bp, Homo sapiens
aagaagcacctggac

SEQ ID NO: 81669 - DNA, 15 bp, Homo sapiens
agaagcacctggacc

SEQ ID NO: 81670 - DNA, 15 bp, Homo sapiens
gaagcacctggaccc

SEQ ID NO: 81671 - DNA, 15 bp, Homo sapiens
aagcacctggacccc

SEQ ID NO: 81672 - DNA, 15 bp, Homo sapiens
agcacctggacccca

SEQ ID NO: 81673 - DNA, 15 bp, Homo sapiens
gcacctggaccccag

SEQ ID NO: 81674 - DNA, 15 bp, Homo sapiens
cacctggaccccagg

SEQ ID NO: 81675 - DNA, 15 bp, Homo sapiens
acctggaccccaggc

SEQ ID NO: 81676 - DNA, 15 bp, Homo sapiens
cctggaccccaggcc

SEQ ID NO: 81677 - DNA, 15 bp, Homo sapiens
ctggaccccaggccc

SEQ ID NO: 81678 - DNA, 15 bp, Homo sapiens
tggaccccaggcccg

SEQ ID NO: 81679 - DNA, 15 bp, Homo sapiens
ggaccccaggcccgg

SEQ ID NO: 81680 - DNA, 15 bp, Homo sapiens
gaccccaggcccggg

SEQ ID NO: 81681 - DNA, 15 bp, Homo sapiens
accccaggcccgggc

SEQ ID NO: 81682 - DNA, 15 bp, Homo sapiens
ccccaggcccgggcc

SEQ ID NO: 81683 - DNA, 15 bp, Homo sapiens
cccaggcccgggccc

SEQ ID NO: 81684 - DNA, 15 bp, Homo sapiens
ccaggcccgggccct

SEQ ID NO: 81685 - DNA, 15 bp, Homo sapiens
caggcccgggccctg

SEQ ID NO: 81686 - DNA, 15 bp, Homo sapiens
aggcccgggccctgc

SEQ ID NO: 81687 - DNA, 15 bp, Homo sapiens
ggcccgggccctgcc

SEQ ID NO: 81688 - DNA, 15 bp, Homo sapiens
gcccgggccctgccc

SEQ ID NO: 81689 - DNA, 15 bp, Homo sapiens
cccgggccctgccca

SEQ ID NO: 81690 - DNA, 15 bp, Homo sapiens
ccgggccctgcccac

SEQ ID NO: 81691 - DNA, 15 bp, Homo sapiens
cgggccctgcccacc

SEQ ID NO: 81692 - DNA, 15 bp, Homo sapiens
gggccctgcccacct

SEQ ID NO: 81693 - DNA, 15 bp, Homo sapiens
ggccctgcccacctg

SEQ ID NO: 81694 - DNA, 15 bp, Homo sapiens
gccctgcccacctga

SEQ ID NO: 81695 - DNA, 15 bp, Homo sapiens
ccctgcccacctgag

SEQ ID NO: 81696 - DNA, 15 bp, Homo sapiens
cctgcccacctgagc

SEQ ID NO: 81697 - DNA, 15 bp, Homo sapiens
ctgcccacctgagct

SEQ ID NO: 81698 - DNA, 15 bp, Homo sapiens
tgcccacctgagctg

SEQ ID NO: 81699 - DNA, 15 bp, Homo sapiens
gcccacctgagctgg

SEQ ID NO: 81700 - DNA, 15 bp, Homo sapiens
cccacctgagctggg

SEQ ID NO: 81701 - DNA, 15 bp, Homo sapiens
ccacctgagctgggc

SEQ ID NO: 81702 - DNA, 15 bp, Homo sapiens
cacctgagctgggcc

SEQ ID NO: 81703 - DNA, 15 bp, Homo sapiens
acctgagctgggcct

SEQ ID NO: 81704 - DNA, 15 bp, Homo sapiens
cctgagctgggcctg

SEQ ID NO: 81705 - DNA, 15 bp, Homo sapiens
ctgagctgggcctgg

SEQ ID NO: 81706 - DNA, 15 bp, Homo sapiens
tgagctgggcctggg

SEQ ID NO: 81707 - DNA, 15 bp, Homo sapiens
gagctgggcctgggc

SEQ ID NO: 81708 - DNA, 15 bp, Homo sapiens
agctgggcctgggcc

SEQ ID NO: 81709 - DNA, 15 bp, Homo sapiens
gctgggcctgggcct

SEQ ID NO: 81710 - DNA, 15 bp, Homo sapiens
ctgggcctgggcctg

SEQ ID NO: 81711 - DNA, 15 bp, Homo sapiens
tgggcctgggcctgg

SEQ ID NO: 81712 - DNA, 15 bp, Homo sapiens
gggcctgggcctggg

SEQ ID NO: 81713 - DNA, 15 bp, Homo sapiens
ggcctgggcctgggc

SEQ ID NO: 81714 - DNA, 15 bp, Homo sapiens
gcctgggcctgggcc

SEQ ID NO: 81715 - DNA, 15 bp, Homo sapiens
cctgggcctgggcca

SEQ ID NO: 81716 - DNA, 15 bp, Homo sapiens
ctgggcctgggccag

SEQ ID NO: 81717 - DNA, 15 bp, Homo sapiens
tgggcctgggccagc

SEQ ID NO: 81718 - DNA, 15 bp, Homo sapiens
gggcctgggccagct

SEQ ID NO: 81719 - DNA, 15 bp, Homo sapiens
ggcctgggccagctg

SEQ ID NO: 81720 - DNA, 15 bp, Homo sapiens
gcctgggccagctgg

SEQ ID NO: 81721 - DNA, 15 bp, Homo sapiens
cctgggccagctggc

SEQ ID NO: 81722 - DNA, 15 bp, Homo sapiens
ctgggccagctggcc

SEQ ID NO: 81723 - DNA, 15 bp, Homo sapiens
tgggccagctggcct

SEQ ID NO: 81724 - DNA, 15 bp, Homo sapiens
gggccagctggcctg

SEQ ID NO: 81725 - DNA, 15 bp, Homo sapiens
ggccagctggcctgc

SEQ ID NO: 81726 - DNA, 15 bp, Homo sapiens
gccagctggcctgct

SEQ ID NO: 81727 - DNA, 15 bp, Homo sapiens
ccagctggcctgctg

SEQ ID NO: 81728 - DNA, 15 bp, Homo sapiens
cagctggcctgctgc

SEQ ID NO: 81729 - DNA, 15 bp, Homo sapiens
agctggcctgctgct

SEQ ID NO: 81730 - DNA, 15 bp, Homo sapiens
gctggcctgctgctg

SEQ ID NO: 81731 - DNA, 15 bp, Homo sapiens
ctggcctgctgctgc

SEQ ID NO: 81732 - DNA, 15 bp, Homo sapiens
tggcctgctgctgcc

SEQ ID NO: 81733 - DNA, 15 bp, Homo sapiens
ggcctgctgctgcct

SEQ ID NO: 81734 - DNA, 15 bp, Homo sapiens
gcctgctgctgcctg

SEQ ID NO: 81735 - DNA, 15 bp, Homo sapiens
cctgctgctgcctgc

SEQ ID NO: 81736 - DNA, 15 bp, Homo sapiens
ctgctgctgcctgca

SEQ ID NO: 81737 - DNA, 15 bp, Homo sapiens
tgctgctgcctgcac

SEQ ID NO: 81738 - DNA, 15 bp, Homo sapiens
gctgctgcctgcacc

SEQ ID NO: 81739 - DNA, 15 bp, Homo sapiens
ctgctgcctgcaccg

SEQ ID NO: 81740 - DNA, 15 bp, Homo sapiens
tgctgcctgcaccgc

SEQ ID NO: 81741 - DNA, 15 bp, Homo sapiens
gctgcctgcaccgcc

SEQ ID NO: 81742 - DNA, 15 bp, Homo sapiens
ctgcctgcaccgccg

SEQ ID NO: 81743 - DNA, 15 bp, Homo sapiens
tgcctgcaccgccgg

SEQ ID NO: 81744 - DNA, 15 bp, Homo sapiens
gcctgcaccgccggg

SEQ ID NO: 81745 - DNA, 15 bp, Homo sapiens
cctgcaccgccgggc

SEQ ID NO: 81746 - DNA, 15 bp, Homo sapiens
ctgcaccgccgggcc

SEQ ID NO: 81747 - DNA, 15 bp, Homo sapiens
tgcaccgccgggcca

SEQ ID NO: 81748 - DNA, 15 bp, Homo sapiens
gcaccgccgggccaa

SEQ ID NO: 81749 - DNA, 15 bp, Homo sapiens
caccgccgggccaaa

SEQ ID NO: 81750 - DNA, 15 bp, Homo sapiens
accgccgggccaaaa

SEQ ID NO: 81751 - DNA, 15 bp, Homo sapiens
ccgccgggccaaaag

SEQ ID NO: 81752 - DNA, 15 bp, Homo sapiens
cgccgggccaaaagg

SEQ ID NO: 81753 - DNA, 15 bp, Homo sapiens
gccgggccaaaagga

SEQ ID NO: 81754 - DNA, 15 bp, Homo sapiens
ccgggccaaaaggag

SEQ ID NO: 81755 - DNA, 15 bp, Homo sapiens
cgggccaaaaggagg

SEQ ID NO: 81756 - DNA, 15 bp, Homo sapiens
gggccaaaaggaggc

SEQ ID NO: 81757 - DNA, 15 bp, Homo sapiens
ggccaaaaggaggcc

SEQ ID NO: 81758 - DNA, 15 bp, Homo sapiens
gccaaaaggaggcct

SEQ ID NO: 81759 - DNA, 15 bp, Homo sapiens
ccaaaaggaggcctc

SEQ ID NO: 81760 - DNA, 15 bp, Homo sapiens
caaaaggaggcctcc

SEQ ID NO: 81761 - DNA, 15 bp, Homo sapiens
aaaaggaggcctcct

SEQ ID NO: 81762 - DNA, 15 bp, Homo sapiens
aaaggaggcctccta

SEQ ID NO: 81763 - DNA, 15 bp, Homo sapiens
aaggaggcctcctat

SEQ ID NO: 81764 - DNA, 15 bp, Homo sapiens
aggaggcctcctatg

SEQ ID NO: 81765 - DNA, 15 bp, Homo sapiens
ggaggcctcctatga

SEQ ID NO: 81766 - DNA, 15 bp, Homo sapiens
gaggcctcctatgac

SEQ ID NO: 81767 - DNA, 15 bp, Homo sapiens
aggcctcctatgacc

SEQ ID NO: 81768 - DNA, 15 bp, Homo sapiens
ggcctcctatgaccc

SEQ ID NO: 81769 - DNA, 15 bp, Homo sapiens
gcctcctatgaccca

SEQ ID NO: 81770 - DNA, 15 bp, Homo sapiens
cctcctatgacccag

SEQ ID NO: 81771 - DNA, 15 bp, Homo sapiens
ctcctatgacccagg

SEQ ID NO: 81772 - DNA, 15 bp, Homo sapiens
tcctatgacccaggt

SEQ ID NO: 81773 - DNA, 15 bp, Homo sapiens
cctatgacccaggta

SEQ ID NO: 81774 - DNA, 15 bp, Homo sapiens
ctatgacccaggtag

SEQ ID NO: 81775 - DNA, 15 bp, Homo sapiens
tatgacccaggtagc

SEQ ID NO: 81776 - DNA, 15 bp, Homo sapiens
atgacccaggtagcc

SEQ ID NO: 81777 - DNA, 15 bp, Homo sapiens
tgacccaggtagcca

SEQ ID NO: 81778 - DNA, 15 bp, Homo sapiens
gacccaggtagccag

SEQ ID NO: 81779 - DNA, 15 bp, Homo sapiens
acccaggtagccagc

SEQ ID NO: 81780 - DNA, 15 bp, Homo sapiens
cccaggtagccagct

SEQ ID NO: 81781 - DNA, 15 bp, Homo sapiens
ccaggtagccagctg

SEQ ID NO: 81782 - DNA, 15 bp, Homo sapiens
caggtagccagctgc

SEQ ID NO: 81783 - DNA, 15 bp, Homo sapiens
aggtagccagctgcg

SEQ ID NO: 81784 - DNA, 15 bp, Homo sapiens
ggtagccagctgcgc

SEQ ID NO: 81785 - DNA, 15 bp, Homo sapiens
gtagccagctgcgca

SEQ ID NO: 81786 - DNA, 15 bp, Homo sapiens
tagccagctgcgcac

SEQ ID NO: 81787 - DNA, 15 bp, Homo sapiens
agccagctgcgcact

SEQ ID NO: 81788 - DNA, 15 bp, Homo sapiens
gccagctgcgcactg

SEQ ID NO: 81789 - DNA, 15 bp, Homo sapiens
ccagctgcgcactgg

SEQ ID NO: 81790 - DNA, 15 bp, Homo sapiens
cagctgcgcactggg

SEQ ID NO: 81791 - DNA, 15 bp, Homo sapiens
agctgcgcactggga

SEQ ID NO: 81792 - DNA, 15 bp, Homo sapiens
gctgcgcactgggac

SEQ ID NO: 81793 - DNA, 15 bp, Homo sapiens
ctgcgcactgggacg

SEQ ID NO: 81794 - DNA, 15 bp, Homo sapiens
tgcgcactgggacgg

SEQ ID NO: 81795 - DNA, 15 bp, Homo sapiens
gcgcactgggacggg

SEQ ID NO: 81796 - DNA, 15 bp, Homo sapiens
cgcactgggacgggg

SEQ ID NO: 81797 - DNA, 15 bp, Homo sapiens
gcactgggacggggt

SEQ ID NO: 81798 - DNA, 15 bp, Homo sapiens
cactgggacggggtg

SEQ ID NO: 81799 - DNA, 15 bp, Homo sapiens
actgggacggggtgg

SEQ ID NO: 81800 - DNA, 15 bp, Homo sapiens
ctgggacggggtggc

SEQ ID NO: 81801 - DNA, 15 bp, Homo sapiens
tgggacggggtggcc

SEQ ID NO: 81802 - DNA, 15 bp, Homo sapiens
gggacggggtggcca

SEQ ID NO: 81803 - DNA, 15 bp, Homo sapiens
ggacggggtggccag

SEQ ID NO: 81804 - DNA, 15 bp, Homo sapiens
gacggggtggccaga

SEQ ID NO: 81805 - DNA, 15 bp, Homo sapiens
acggggtggccagat

SEQ ID NO: 81806 - DNA, 15 bp, Homo sapiens
cggggtggccagata

SEQ ID NO: 81807 - DNA, 15 bp, Homo sapiens
ggggtggccagatag

SEQ ID NO: 81808 - DNA, 15 bp, Homo sapiens
gggtggccagataga

SEQ ID NO: 81809 - DNA, 15 bp, Homo sapiens
ggtggccagatagaa

SEQ ID NO: 81810 - DNA, 15 bp, Homo sapiens
gtggccagatagaaa

SEQ ID NO: 81811 - DNA, 15 bp, Homo sapiens
tggccagatagaaag

SEQ ID NO: 81812 - DNA, 15 bp, Homo sapiens
ggccagatagaaagc

SEQ ID NO: 81813 - DNA, 15 bp, Homo sapiens
gccagatagaaagcc

SEQ ID NO: 81814 - DNA, 15 bp, Homo sapiens
ccagatagaaagccc

SEQ ID NO: 81815 - DNA, 15 bp, Homo sapiens
cagatagaaagcccg

SEQ ID NO: 81816 - DNA, 15 bp, Homo sapiens
agatagaaagcccgc

SEQ ID NO: 81817 - DNA, 15 bp, Homo sapiens
gatagaaagcccgca

SEQ ID NO: 81818 - DNA, 15 bp, Homo sapiens
atagaaagcccgcat

SEQ ID NO: 81819 - DNA, 15 bp, Homo sapiens
tagaaagcccgcatt

SEQ ID NO: 81820 - DNA, 15 bp, Homo sapiens
agaaagcccgcattc

SEQ ID NO: 81821 - DNA, 15 bp, Homo sapiens
gaaagcccgcattcc

SEQ ID NO: 81822 - DNA, 15 bp, Homo sapiens
aaagcccgcattcca

SEQ ID NO: 81823 - DNA, 15 bp, Homo sapiens
aagcccgcattccag

SEQ ID NO: 81824 - DNA, 15 bp, Homo sapiens
agcccgcattccagg

SEQ ID NO: 81825 - DNA, 15 bp, Homo sapiens
gcccgcattccaggc

SEQ ID NO: 81826 - DNA, 15 bp, Homo sapiens
cccgcattccaggcc

SEQ ID NO: 81827 - DNA, 15 bp, Homo sapiens
ccgcattccaggcct

SEQ ID NO: 81828 - DNA, 15 bp, Homo sapiens
cgcattccaggcctt

SEQ ID NO: 81829 - DNA, 15 bp, Homo sapiens
gcattccaggccttg

SEQ ID NO: 81830 - DNA, 15 bp, Homo sapiens
cattccaggccttgc

SEQ ID NO: 81831 - DNA, 15 bp, Homo sapiens
attccaggccttgct

SEQ ID NO: 81832 - DNA, 15 bp, Homo sapiens
ttccaggccttgctc

SEQ ID NO: 81833 - DNA, 15 bp, Homo sapiens
tccaggccttgctct

SEQ ID NO: 81834 - DNA, 15 bp, Homo sapiens
ccaggccttgctctg

SEQ ID NO: 81835 - DNA, 15 bp, Homo sapiens
caggccttgctctgt

SEQ ID NO: 81836 - DNA, 15 bp, Homo sapiens
aggccttgctctgta

SEQ ID NO: 81837 - DNA, 15 bp, Homo sapiens
ggccttgctctgtag

SEQ ID NO: 81838 - DNA, 15 bp, Homo sapiens
gccttgctctgtagt

SEQ ID NO: 81839 - DNA, 15 bp, Homo sapiens
ccttgctctgtagtg

SEQ ID NO: 81840 - DNA, 15 bp, Homo sapiens
cttgctctgtagtga

SEQ ID NO: 81841 - DNA, 15 bp, Homo sapiens
ttgctctgtagtgac

SEQ ID NO: 81842 - DNA, 15 bp, Homo sapiens
tgctctgtagtgacc

SEQ ID NO: 81843 - DNA, 15 bp, Homo sapiens
gctctgtagtgaccc

SEQ ID NO: 81844 - DNA, 15 bp, Homo sapiens
ctctgtagtgacccc

SEQ ID NO: 81845 - DNA, 15 bp, Homo sapiens
tctgtagtgacccca

SEQ ID NO: 81846 - DNA, 15 bp, Homo sapiens
ctgtagtgaccccat

SEQ ID NO: 81847 - DNA, 15 bp, Homo sapiens
tgtagtgaccccatc

SEQ ID NO: 81848 - DNA, 15 bp, Homo sapiens
gtagtgaccccatct

SEQ ID NO: 81849 - DNA, 15 bp, Homo sapiens
tagtgaccccatctc

SEQ ID NO: 81850 - DNA, 15 bp, Homo sapiens
agtgaccccatctca

SEQ ID NO: 81851 - DNA, 15 bp, Homo sapiens
gtgaccccatctcag

SEQ ID NO: 81852 - DNA, 15 bp, Homo sapiens
tgaccccatctcagc

SEQ ID NO: 81853 - DNA, 15 bp, Homo sapiens
gaccccatctcagca

SEQ ID NO: 81854 - DNA, 15 bp, Homo sapiens
accccatctcagcac

SEQ ID NO: 81855 - DNA, 15 bp, Homo sapiens
ccccatctcagcacc

SEQ ID NO: 81856 - DNA, 15 bp, Homo sapiens
cccatctcagcacct

SEQ ID NO: 81857 - DNA, 15 bp, Homo sapiens
ccatctcagcacctg

SEQ ID NO: 81858 - DNA, 15 bp, Homo sapiens
catctcagcacctgc

SEQ ID NO: 81859 - DNA, 15 bp, Homo sapiens
atctcagcacctgct

SEQ ID NO: 81860 - DNA, 15 bp, Homo sapiens
tctcagcacctgcta

SEQ ID NO: 81861 - DNA, 15 bp, Homo sapiens
ctcagcacctgctag

SEQ ID NO: 81862 - DNA, 15 bp, Homo sapiens
tcagcacctgctagg

SEQ ID NO: 81863 - DNA, 15 bp, Homo sapiens
cagcacctgctaggt

SEQ ID NO: 81864 - DNA, 15 bp, Homo sapiens
agcacctgctaggtc

SEQ ID NO: 81865 - DNA, 15 bp, Homo sapiens
gcacctgctaggtct

SEQ ID NO: 81866 - DNA, 15 bp, Homo sapiens
cacctgctaggtctc

SEQ ID NO: 81867 - DNA, 15 bp, Homo sapiens
acctgctaggtctct

SEQ ID NO: 81868 - DNA, 15 bp, Homo sapiens
cctgctaggtctctc

SEQ ID NO: 81869 - DNA, 15 bp, Homo sapiens
ctgctaggtctctct

SEQ ID NO: 81870 - DNA, 15 bp, Homo sapiens
tgctaggtctctctg

SEQ ID NO: 81871 - DNA, 15 bp, Homo sapiens
gctaggtctctctgg

SEQ ID NO: 81872 - DNA, 15 bp, Homo sapiens
ctaggtctctctgga

SEQ ID NO: 81873 - DNA, 15 bp, Homo sapiens
taggtctctctggag

SEQ ID NO: 81874 - DNA, 15 bp, Homo sapiens
aggtctctctggagt

SEQ ID NO: 81875 - DNA, 15 bp, Homo sapiens
ggtctctctggagtc

SEQ ID NO: 81876 - DNA, 15 bp, Homo sapiens
gtctctctggagtct

SEQ ID NO: 81877 - DNA, 15 bp, Homo sapiens
tctctctggagtctc

SEQ ID NO: 81878 - DNA, 15 bp, Homo sapiens
ctctctggagtctcc

SEQ ID NO: 81879 - DNA, 15 bp, Homo sapiens
tctctggagtctcca

SEQ ID NO: 81880 - DNA, 15 bp, Homo sapiens
ctctggagtctccac

SEQ ID NO: 81881 - DNA, 15 bp, Homo sapiens
tctggagtctccaca

SEQ ID NO: 81882 - DNA, 15 bp, Homo sapiens
ctggagtctccacac

SEQ ID NO: 81883 - DNA, 15 bp, Homo sapiens
tggagtctccacaca

SEQ ID NO: 81884 - DNA, 15 bp, Homo sapiens
ggagtctccacacat

SEQ ID NO: 81885 - DNA, 15 bp, Homo sapiens
gagtctccacacatt

SEQ ID NO: 81886 - DNA, 15 bp, Homo sapiens
agtctccacacattt

SEQ ID NO: 81887 - DNA, 15 bp, Homo sapiens
gtctccacacatttc

SEQ ID NO: 81888 - DNA, 15 bp, Homo sapiens
tctccacacatttct

SEQ ID NO: 81889 - DNA, 15 bp, Homo sapiens
ctccacacatttctt

SEQ ID NO: 81890 - DNA, 15 bp, Homo sapiens
tccacacatttcttg

SEQ ID NO: 81891 - DNA, 15 bp, Homo sapiens
ccacacatttcttgc

SEQ ID NO: 81892 - DNA, 15 bp, Homo sapiens
cacacatttcttgct

SEQ ID NO: 81893 - DNA, 15 bp, Homo sapiens
acacatttcttgctt

SEQ ID NO: 81894 - DNA, 15 bp, Homo sapiens
cacatttcttgcttg

SEQ ID NO: 81895 - DNA, 15 bp, Homo sapiens
acatttcttgcttgc

SEQ ID NO: 81896 - DNA, 15 bp, Homo sapiens
catttcttgcttgcc

SEQ ID NO: 81897 - DNA, 15 bp, Homo sapiens
atttcttgcttgccc

SEQ ID NO: 81898 - DNA, 15 bp, Homo sapiens
tttcttgcttgccct

SEQ ID NO: 81899 - DNA, 15 bp, Homo sapiens
ttcttgcttgccctt

SEQ ID NO: 81900 - DNA, 15 bp, Homo sapiens
tcttgcttgcccttt

SEQ ID NO: 81901 - DNA, 15 bp, Homo sapiens
cttgcttgccctttg

SEQ ID NO: 81902 - DNA, 15 bp, Homo sapiens
ttgcttgccctttgg

SEQ ID NO: 81903 - DNA, 15 bp, Homo sapiens
tgcttgccctttggt

SEQ ID NO: 81904 - DNA, 15 bp, Homo sapiens
gcttgccctttggtt

SEQ ID NO: 81905 - DNA, 15 bp, Homo sapiens
cttgccctttggttc

SEQ ID NO: 81906 - DNA, 15 bp, Homo sapiens
ttgccctttggttct

SEQ ID NO: 81907 - DNA, 15 bp, Homo sapiens
tgccctttggttctg

SEQ ID NO: 81908 - DNA, 15 bp, Homo sapiens
gccctttggttctgt

SEQ ID NO: 81909 - DNA, 15 bp, Homo sapiens
ccctttggttctgtt

SEQ ID NO: 81910 - DNA, 15 bp, Homo sapiens
cctttggttctgttt

SEQ ID NO: 81911 - DNA, 15 bp, Homo sapiens
ctttggttctgtttg

SEQ ID NO: 81912 - DNA, 15 bp, Homo sapiens
tttggttctgtttgg

SEQ ID NO: 81913 - DNA, 15 bp, Homo sapiens
ttggttctgtttggg

SEQ ID NO: 81914 - DNA, 15 bp, Homo sapiens
tggttctgtttgggg

SEQ ID NO: 81915 - DNA, 15 bp, Homo sapiens
ggttctgtttggggc

SEQ ID NO: 81916 - DNA, 15 bp, Homo sapiens
gttctgtttggggca

SEQ ID NO: 81917 - DNA, 15 bp, Homo sapiens
ttctgtttggggcag

SEQ ID NO: 81918 - DNA, 15 bp, Homo sapiens
tctgtttggggcagc

SEQ ID NO: 81919 - DNA, 15 bp, Homo sapiens
ctgtttggggcagcg

SEQ ID NO: 81920 - DNA, 15 bp, Homo sapiens
tgtttggggcagcgc

SEQ ID NO: 81921 - DNA, 15 bp, Homo sapiens
gtttggggcagcgcc

SEQ ID NO: 81922 - DNA, 15 bp, Homo sapiens
tttggggcagcgccc

SEQ ID NO: 81923 - DNA, 15 bp, Homo sapiens
ttggggcagcgcccc

SEQ ID NO: 81924 - DNA, 15 bp, Homo sapiens
tggggcagcgcccct

SEQ ID NO: 81925 - DNA, 15 bp, Homo sapiens
ggggcagcgcccctc

SEQ ID NO: 81926 - DNA, 15 bp, Homo sapiens
gggcagcgcccctct

SEQ ID NO: 81927 - DNA, 15 bp, Homo sapiens
ggcagcgcccctctg

SEQ ID NO: 81928 - DNA, 15 bp, Homo sapiens
gcagcgcccctctga

SEQ ID NO: 81929 - DNA, 15 bp, Homo sapiens
cagcgcccctctgaa

SEQ ID NO: 81930 - DNA, 15 bp, Homo sapiens
agcgcccctctgaac

SEQ ID NO: 81931 - DNA, 15 bp, Homo sapiens
gcgcccctctgaact

SEQ ID NO: 81932 - DNA, 15 bp, Homo sapiens
cgcccctctgaactg

SEQ ID NO: 81933 - DNA, 15 bp, Homo sapiens
gcccctctgaactga

SEQ ID NO: 81934 - DNA, 15 bp, Homo sapiens
cccctctgaactgag

SEQ ID NO: 81935 - DNA, 15 bp, Homo sapiens
ccctctgaactgagg

SEQ ID NO: 81936 - DNA, 15 bp, Homo sapiens
cctctgaactgaggg

SEQ ID NO: 81937 - DNA, 15 bp, Homo sapiens
ctctgaactgagggg

SEQ ID NO: 81938 - DNA, 15 bp, Homo sapiens
tctgaactgaggggc

SEQ ID NO: 81939 - DNA, 15 bp, Homo sapiens
ctgaactgaggggcc

SEQ ID NO: 81940 - DNA, 15 bp, Homo sapiens
tgaactgaggggccc

SEQ ID NO: 81941 - DNA, 15 bp, Homo sapiens
gaactgaggggcccc

SEQ ID NO: 81942 - DNA, 15 bp, Homo sapiens
aactgaggggccccg

SEQ ID NO: 81943 - DNA, 15 bp, Homo sapiens
actgaggggccccgg

SEQ ID NO: 81944 - DNA, 15 bp, Homo sapiens
ctgaggggccccggg

SEQ ID NO: 81945 - DNA, 15 bp, Homo sapiens
tgaggggccccgggc

SEQ ID NO: 81946 - DNA, 15 bp, Homo sapiens
gaggggccccgggca

SEQ ID NO: 81947 - DNA, 15 bp, Homo sapiens
aggggccccgggcag

SEQ ID NO: 81948 - DNA, 15 bp, Homo sapiens
ggggccccgggcagt

SEQ ID NO: 81949 - DNA, 15 bp, Homo sapiens
gggccccgggcagtc

SEQ ID NO: 81950 - DNA, 15 bp, Homo sapiens
ggccccgggcagtcc

SEQ ID NO: 81951 - DNA, 15 bp, Homo sapiens
gccccgggcagtcct

SEQ ID NO: 81952 - DNA, 15 bp, Homo sapiens
ccccgggcagtcctg

SEQ ID NO: 81953 - DNA, 15 bp, Homo sapiens
cccgggcagtcctgc

SEQ ID NO: 81954 - DNA, 15 bp, Homo sapiens
ccgggcagtcctgct

SEQ ID NO: 81955 - DNA, 15 bp, Homo sapiens
cgggcagtcctgctt

SEQ ID NO: 81956 - DNA, 15 bp, Homo sapiens
gggcagtcctgcttt

SEQ ID NO: 81957 - DNA, 15 bp, Homo sapiens
ggcagtcctgctttg

SEQ ID NO: 81958 - DNA, 15 bp, Homo sapiens
gcagtcctgctttgc

SEQ ID NO: 81959 - DNA, 15 bp, Homo sapiens
cagtcctgctttgcg

SEQ ID NO: 81960 - DNA, 15 bp, Homo sapiens
agtcctgctttgcgg

SEQ ID NO: 81961 - DNA, 15 bp, Homo sapiens
gtcctgctttgcgga

SEQ ID NO: 81962 - DNA, 15 bp, Homo sapiens
tcctgctttgcggag

SEQ ID NO: 81963 - DNA, 15 bp, Homo sapiens
cctgctttgcggagc

SEQ ID NO: 81964 - DNA, 15 bp, Homo sapiens
ctgctttgcggagcc

SEQ ID NO: 81965 - DNA, 15 bp, Homo sapiens
tgctttgcggagccc

SEQ ID NO: 81966 - DNA, 15 bp, Homo sapiens
gctttgcggagccca

SEQ ID NO: 81967 - DNA, 15 bp, Homo sapiens
ctttgcggagcccag

SEQ ID NO: 81968 - DNA, 15 bp, Homo sapiens
tttgcggagcccagc

SEQ ID NO: 81969 - DNA, 15 bp, Homo sapiens
ttgcggagcccagct

SEQ ID NO: 81970 - DNA, 15 bp, Homo sapiens
tgcggagcccagctc

SEQ ID NO: 81971 - DNA, 15 bp, Homo sapiens
gcggagcccagctcc

SEQ ID NO: 81972 - DNA, 15 bp, Homo sapiens
cggagcccagctccg

SEQ ID NO: 81973 - DNA, 15 bp, Homo sapiens
ggagcccagctccga

SEQ ID NO: 81974 - DNA, 15 bp, Homo sapiens
gagcccagctccgac

SEQ ID NO: 81975 - DNA, 15 bp, Homo sapiens
agcccagctccgacc

SEQ ID NO: 81976 - DNA, 15 bp, Homo sapiens
gcccagctccgaccc

SEQ ID NO: 81977 - DNA, 15 bp, Homo sapiens
cccagctccgacccc

SEQ ID NO: 81978 - DNA, 15 bp, Homo sapiens
ccagctccgaccccc

SEQ ID NO: 81979 - DNA, 15 bp, Homo sapiens
cagctccgaccccct

SEQ ID NO: 81980 - DNA, 15 bp, Homo sapiens
agctccgaccccctt

SEQ ID NO: 81981 - DNA, 15 bp, Homo sapiens
gctccgacccccttc

SEQ ID NO: 81982 - DNA, 15 bp, Homo sapiens
ctccgacccccttca

SEQ ID NO: 81983 - DNA, 15 bp, Homo sapiens
tccgacccccttcac

SEQ ID NO: 81984 - DNA, 15 bp, Homo sapiens
ccgacccccttcaca

SEQ ID NO: 81985 - DNA, 15 bp, Homo sapiens
cgacccccttcacat

SEQ ID NO: 81986 - DNA, 15 bp, Homo sapiens
gacccccttcacata

SEQ ID NO: 81987 - DNA, 15 bp, Homo sapiens
acccccttcacatag

SEQ ID NO: 81988 - DNA, 15 bp, Homo sapiens
cccccttcacataga

SEQ ID NO: 81989 - DNA, 15 bp, Homo sapiens
ccccttcacatagag

SEQ ID NO: 81990 - DNA, 15 bp, Homo sapiens
cccttcacatagaga

SEQ ID NO: 81991 - DNA, 15 bp, Homo sapiens
ccttcacatagagag

SEQ ID NO: 81992 - DNA, 15 bp, Homo sapiens
cttcacatagagaga

SEQ ID NO: 81993 - DNA, 15 bp, Homo sapiens
ttcacatagagagaa

SEQ ID NO: 81994 - DNA, 15 bp, Homo sapiens
tcacatagagagaag

SEQ ID NO: 81995 - DNA, 15 bp, Homo sapiens
cacatagagagaagg

SEQ ID NO: 81996 - DNA, 15 bp, Homo sapiens
acatagagagaagga

SEQ ID NO: 81997 - DNA, 15 bp, Homo sapiens
catagagagaaggaa

SEQ ID NO: 81998 - DNA, 15 bp, Homo sapiens
atagagagaaggaaa

SEQ ID NO: 81999 - DNA, 15 bp, Homo sapiens
tagagagaaggaaag

SEQ ID NO: 82000 - DNA, 15 bp, Homo sapiens
agagagaaggaaaga

SEQ ID NO: 82001 - DNA, 15 bp, Homo sapiens
gagagaaggaaagag

SEQ ID NO: 82002 - DNA, 15 bp, Homo sapiens
agagaaggaaagagc

SEQ ID NO: 82003 - DNA, 15 bp, Homo sapiens
gagaaggaaagagct

SEQ ID NO: 82004 - DNA, 15 bp, Homo sapiens
agaaggaaagagctg

SEQ ID NO: 82005 - DNA, 15 bp, Homo sapiens
gaaggaaagagctgc

SEQ ID NO: 82006 - DNA, 15 bp, Homo sapiens
aaggaaagagctgct

SEQ ID NO: 82007 - DNA, 15 bp, Homo sapiens
aggaaagagctgctg

SEQ ID NO: 82008 - DNA, 15 bp, Homo sapiens
ggaaagagctgctgc

SEQ ID NO: 82009 - DNA, 15 bp, Homo sapiens
gaaagagctgctgcc

SEQ ID NO: 82010 - DNA, 15 bp, Homo sapiens
aaagagctgctgccg

SEQ ID NO: 82011 - DNA, 15 bp, Homo sapiens
aagagctgctgccgc

SEQ ID NO: 82012 - DNA, 15 bp, Homo sapiens
agagctgctgccgcg

SEQ ID NO: 82013 - DNA, 15 bp, Homo sapiens
gagctgctgccgcgc

SEQ ID NO: 82014 - DNA, 15 bp, Homo sapiens
agctgctgccgcgcc

SEQ ID NO: 82015 - DNA, 15 bp, Homo sapiens
gctgctgccgcgccc

SEQ ID NO: 82016 - DNA, 15 bp, Homo sapiens
ctgctgccgcgcccc

SEQ ID NO: 82017 - DNA, 15 bp, Homo sapiens
tgctgccgcgccccc

SEQ ID NO: 82018 - DNA, 15 bp, Homo sapiens
gctgccgcgccccct

SEQ ID NO: 82019 - DNA, 15 bp, Homo sapiens
ctgccgcgccccctg

SEQ ID NO: 82020 - DNA, 15 bp, Homo sapiens
tgccgcgccccctgc

SEQ ID NO: 82021 - DNA, 15 bp, Homo sapiens
gccgcgccccctgct

SEQ ID NO: 82022 - DNA, 15 bp, Homo sapiens
ccgcgccccctgctg

SEQ ID NO: 82023 - DNA, 15 bp, Homo sapiens
cgcgccccctgctgg

SEQ ID NO: 82024 - DNA, 15 bp, Homo sapiens
gcgccccctgctggg

SEQ ID NO: 82025 - DNA, 15 bp, Homo sapiens
cgccccctgctgggc

SEQ ID NO: 82026 - DNA, 15 bp, Homo sapiens
gccccctgctgggcg

SEQ ID NO: 82027 - DNA, 15 bp, Homo sapiens
ccccctgctgggcgc

SEQ ID NO: 82028 - DNA, 15 bp, Homo sapiens
cccctgctgggcgca

SEQ ID NO: 82029 - DNA, 15 bp, Homo sapiens
ccctgctgggcgcac

SEQ ID NO: 82030 - DNA, 15 bp, Homo sapiens
cctgctgggcgcact

SEQ ID NO: 82031 - DNA, 15 bp, Homo sapiens
ctgctgggcgcactg

SEQ ID NO: 82032 - DNA, 15 bp, Homo sapiens
tgctgggcgcactgc

SEQ ID NO: 82033 - DNA, 15 bp, Homo sapiens
gctgggcgcactgca

SEQ ID NO: 82034 - DNA, 15 bp, Homo sapiens
ctgggcgcactgcac

SEQ ID NO: 82035 - DNA, 15 bp, Homo sapiens
tgggcgcactgcact

SEQ ID NO: 82036 - DNA, 15 bp, Homo sapiens
gggcgcactgcacta

SEQ ID NO: 82037 - DNA, 15 bp, Homo sapiens
ggcgcactgcactac

SEQ ID NO: 82038 - DNA, 15 bp, Homo sapiens
gcgcactgcactact

SEQ ID NO: 82039 - DNA, 15 bp, Homo sapiens
cgcactgcactactg

SEQ ID NO: 82040 - DNA, 15 bp, Homo sapiens
gcactgcactactgc

SEQ ID NO: 82041 - DNA, 15 bp, Homo sapiens
cactgcactactgca

SEQ ID NO: 82042 - DNA, 15 bp, Homo sapiens
actgcactactgcat

SEQ ID NO: 82043 - DNA, 15 bp, Homo sapiens
ctgcactactgcatc

SEQ ID NO: 82044 - DNA, 15 bp, Homo sapiens
tgcactactgcatct

SEQ ID NO: 82045 - DNA, 15 bp, Homo sapiens
gcactactgcatctg

SEQ ID NO: 82046 - DNA, 15 bp, Homo sapiens
cactactgcatctgc

SEQ ID NO: 82047 - DNA, 15 bp, Homo sapiens
actactgcatctgcc

SEQ ID NO: 82048 - DNA, 15 bp, Homo sapiens
ctactgcatctgcct

SEQ ID NO: 82049 - DNA, 15 bp, Homo sapiens
tactgcatctgcctt

SEQ ID NO: 82050 - DNA, 15 bp, Homo sapiens
actgcatctgccttt

SEQ ID NO: 82051 - DNA, 15 bp, Homo sapiens
ctgcatctgcctttt

SEQ ID NO: 82052 - DNA, 15 bp, Homo sapiens
tgcatctgccttttt

SEQ ID NO: 82053 - DNA, 15 bp, Homo sapiens
gcatctgcctttttc

SEQ ID NO: 82054 - DNA, 15 bp, Homo sapiens
catctgcctttttct

SEQ ID NO: 82055 - DNA, 15 bp, Homo sapiens
atctgcctttttctg

SEQ ID NO: 82056 - DNA, 15 bp, Homo sapiens
tctgcctttttctgt

SEQ ID NO: 82057 - DNA, 15 bp, Homo sapiens
ctgcctttttctgtc

SEQ ID NO: 82058 - DNA, 15 bp, Homo sapiens
tgcctttttctgtcc

SEQ ID NO: 82059 - DNA, 15 bp, Homo sapiens
gcctttttctgtccc

SEQ ID NO: 82060 - DNA, 15 bp, Homo sapiens
cctttttctgtcccc

SEQ ID NO: 82061 - DNA, 15 bp, Homo sapiens
ctttttctgtcccct

SEQ ID NO: 82062 - DNA, 15 bp, Homo sapiens
tttttctgtcccctc

SEQ ID NO: 82063 - DNA, 15 bp, Homo sapiens
ttttctgtcccctcc

SEQ ID NO: 82064 - DNA, 15 bp, Homo sapiens
tttctgtcccctccc

SEQ ID NO: 82065 - DNA, 15 bp, Homo sapiens
ttctgtcccctccct

SEQ ID NO: 82066 - DNA, 15 bp, Homo sapiens
tctgtcccctcccta

SEQ ID NO: 82067 - DNA, 15 bp, Homo sapiens
ctgtcccctccctag

SEQ ID NO: 82068 - DNA, 15 bp, Homo sapiens
tgtcccctccctagt

SEQ ID NO: 82069 - DNA, 15 bp, Homo sapiens
gtcccctccctagta

SEQ ID NO: 82070 - DNA, 15 bp, Homo sapiens
tcccctccctagtac

SEQ ID NO: 82071 - DNA, 15 bp, Homo sapiens
cccctccctagtacc

SEQ ID NO: 82072 - DNA, 15 bp, Homo sapiens
ccctccctagtaccc

SEQ ID NO: 82073 - DNA, 15 bp, Homo sapiens
cctccctagtacccc

SEQ ID NO: 82074 - DNA, 15 bp, Homo sapiens
ctccctagtacccca

SEQ ID NO: 82075 - DNA, 15 bp, Homo sapiens
tccctagtaccccac

SEQ ID NO: 82076 - DNA, 15 bp, Homo sapiens
ccctagtaccccacc

SEQ ID NO: 82077 - DNA, 15 bp, Homo sapiens
cctagtaccccacct

SEQ ID NO: 82078 - DNA, 15 bp, Homo sapiens
ctagtaccccacctc

SEQ ID NO: 82079 - DNA, 15 bp, Homo sapiens
tagtaccccacctct

SEQ ID NO: 82080 - DNA, 15 bp, Homo sapiens
agtaccccacctctt

SEQ ID NO: 82081 - DNA, 15 bp, Homo sapiens
gtaccccacctcttc

SEQ ID NO: 82082 - DNA, 15 bp, Homo sapiens
taccccacctcttct

SEQ ID NO: 82083 - DNA, 15 bp, Homo sapiens
accccacctcttctc

SEQ ID NO: 82084 - DNA, 15 bp, Homo sapiens
ccccacctcttctcc

SEQ ID NO: 82085 - DNA, 15 bp, Homo sapiens
cccacctcttctcct

SEQ ID NO: 82086 - DNA, 15 bp, Homo sapiens
ccacctcttctcctc

SEQ ID NO: 82087 - DNA, 15 bp, Homo sapiens
cacctcttctcctct

SEQ ID NO: 82088 - DNA, 15 bp, Homo sapiens
acctcttctcctctg

SEQ ID NO: 82089 - DNA, 15 bp, Homo sapiens
cctcttctcctctgg

SEQ ID NO: 82090 - DNA, 15 bp, Homo sapiens
ctcttctcctctggt

SEQ ID NO: 82091 - DNA, 15 bp, Homo sapiens
tcttctcctctggtg

SEQ ID NO: 82092 - DNA, 15 bp, Homo sapiens
cttctcctctggtga

SEQ ID NO: 82093 - DNA, 15 bp, Homo sapiens
ttctcctctggtgac

SEQ ID NO: 82094 - DNA, 15 bp, Homo sapiens
tctcctctggtgaca

SEQ ID NO: 82095 - DNA, 15 bp, Homo sapiens
ctcctctggtgacag

SEQ ID NO: 82096 - DNA, 15 bp, Homo sapiens
tcctctggtgacagt

SEQ ID NO: 82097 - DNA, 15 bp, Homo sapiens
cctctggtgacagtt

SEQ ID NO: 82098 - DNA, 15 bp, Homo sapiens
ctctggtgacagttg

SEQ ID NO: 82099 - DNA, 15 bp, Homo sapiens
tctggtgacagttga

SEQ ID NO: 82100 - DNA, 15 bp, Homo sapiens
ctggtgacagttgaa

SEQ ID NO: 82101 - DNA, 15 bp, Homo sapiens
tggtgacagttgaaa

SEQ ID NO: 82102 - DNA, 15 bp, Homo sapiens
ggtgacagttgaaaa

SEQ ID NO: 82103 - DNA, 15 bp, Homo sapiens
gtgacagttgaaaat

SEQ ID NO: 82104 - DNA, 15 bp, Homo sapiens
tgacagttgaaaatg

SEQ ID NO: 82105 - DNA, 15 bp, Homo sapiens
gacagttgaaaatgg

SEQ ID NO: 82106 - DNA, 15 bp, Homo sapiens
acagttgaaaatgga

SEQ ID NO: 82107 - DNA, 15 bp, Homo sapiens
cagttgaaaatggag

SEQ ID NO: 82108 - DNA, 15 bp, Homo sapiens
agttgaaaatggaga

SEQ ID NO: 82109 - DNA, 15 bp, Homo sapiens
gttgaaaatggagag

SEQ ID NO: 82110 - DNA, 15 bp, Homo sapiens
ttgaaaatggagagg

SEQ ID NO: 82111 - DNA, 15 bp, Homo sapiens
tgaaaatggagaggc

SEQ ID NO: 82112 - DNA, 15 bp, Homo sapiens
gaaaatggagaggcc

SEQ ID NO: 82113 - DNA, 15 bp, Homo sapiens
aaaatggagaggccc

SEQ ID NO: 82114 - DNA, 15 bp, Homo sapiens
aaatggagaggcccc

SEQ ID NO: 82115 - DNA, 15 bp, Homo sapiens
aatggagaggccccg

SEQ ID NO: 82116 - DNA, 15 bp, Homo sapiens
atggagaggccccgt

SEQ ID NO: 82117 - DNA, 15 bp, Homo sapiens
tggagaggccccgtt

SEQ ID NO: 82118 - DNA, 15 bp, Homo sapiens
ggagaggccccgttt

SEQ ID NO: 82119 - DNA, 15 bp, Homo sapiens
gagaggccccgtttg

SEQ ID NO: 82120 - DNA, 15 bp, Homo sapiens
agaggccccgtttga

SEQ ID NO: 82121 - DNA, 15 bp, Homo sapiens
gaggccccgtttgag

SEQ ID NO: 82122 - DNA, 15 bp, Homo sapiens
aggccccgtttgagg

SEQ ID NO: 82123 - DNA, 15 bp, Homo sapiens
ggccccgtttgaggg

SEQ ID NO: 82124 - DNA, 15 bp, Homo sapiens
gccccgtttgagggc

SEQ ID NO: 82125 - DNA, 15 bp, Homo sapiens
ccccgtttgagggca

SEQ ID NO: 82126 - DNA, 15 bp, Homo sapiens
cccgtttgagggcag

SEQ ID NO: 82127 - DNA, 15 bp, Homo sapiens
ccgtttgagggcagc

SEQ ID NO: 82128 - DNA, 15 bp, Homo sapiens
cgtttgagggcagcg

SEQ ID NO: 82129 - DNA, 15 bp, Homo sapiens
gtttgagggcagcgg

SEQ ID NO: 82130 - DNA, 15 bp, Homo sapiens
tttgagggcagcggg

SEQ ID NO: 82131 - DNA, 15 bp, Homo sapiens
ttgagggcagcgggg

SEQ ID NO: 82132 - DNA, 15 bp, Homo sapiens
tgagggcagcggggc

SEQ ID NO: 82133 - DNA, 15 bp, Homo sapiens
gagggcagcggggca

SEQ ID NO: 82134 - DNA, 15 bp, Homo sapiens
agggcagcggggcag

SEQ ID NO: 82135 - DNA, 15 bp, Homo sapiens
gggcagcggggcagt

SEQ ID NO: 82136 - DNA, 15 bp, Homo sapiens
ggcagcggggcagtg

SEQ ID NO: 82137 - DNA, 15 bp, Homo sapiens
gcagcggggcagtga

SEQ ID NO: 82138 - DNA, 15 bp, Homo sapiens
cagcggggcagtgag

SEQ ID NO: 82139 - DNA, 15 bp, Homo sapiens
agcggggcagtgaga

SEQ ID NO: 82140 - DNA, 15 bp, Homo sapiens
gcggggcagtgagat

SEQ ID NO: 82141 - DNA, 15 bp, Homo sapiens
cggggcagtgagatt

SEQ ID NO: 82142 - DNA, 15 bp, Homo sapiens
ggggcagtgagattc

SEQ ID NO: 82143 - DNA, 15 bp, Homo sapiens
gggcagtgagattca

SEQ ID NO: 82144 - DNA, 15 bp, Homo sapiens
ggcagtgagattcat

SEQ ID NO: 82145 - DNA, 15 bp, Homo sapiens
gcagtgagattcatt

SEQ ID NO: 82146 - DNA, 15 bp, Homo sapiens
cagtgagattcattt

SEQ ID NO: 82147 - DNA, 15 bp, Homo sapiens
agtgagattcatttt

SEQ ID NO: 82148 - DNA, 15 bp, Homo sapiens
gtgagattcattttg

SEQ ID NO: 82149 - DNA, 15 bp, Homo sapiens
tgagattcattttgt

SEQ ID NO: 82150 - DNA, 15 bp, Homo sapiens
gagattcattttgta

SEQ ID NO: 82151 - DNA, 15 bp, Homo sapiens
agattcattttgtag

SEQ ID NO: 82152 - DNA, 15 bp, Homo sapiens
gattcattttgtaga

SEQ ID NO: 82153 - DNA, 15 bp, Homo sapiens
attcattttgtagaa

SEQ ID NO: 82154 - DNA, 15 bp, Homo sapiens
ttcattttgtagaaa

SEQ ID NO: 82155 - DNA, 15 bp, Homo sapiens
tcattttgtagaaaa

SEQ ID NO: 82156 - DNA, 15 bp, Homo sapiens
cattttgtagaaaag

SEQ ID NO: 82157 - DNA, 15 bp, Homo sapiens
attttgtagaaaaga

SEQ ID NO: 82158 - DNA, 15 bp, Homo sapiens
ttttgtagaaaagaa

SEQ ID NO: 82159 - DNA, 15 bp, Homo sapiens
tttgtagaaaagaac

SEQ ID NO: 82160 - DNA, 15 bp, Homo sapiens
ttgtagaaaagaacg

SEQ ID NO: 82161 - DNA, 15 bp, Homo sapiens
tgtagaaaagaacga

SEQ ID NO: 82162 - DNA, 15 bp, Homo sapiens
gtagaaaagaacgag

SEQ ID NO: 82163 - DNA, 15 bp, Homo sapiens
tagaaaagaacgagg

SEQ ID NO: 82164 - DNA, 15 bp, Homo sapiens
agaaaagaacgaggc

SEQ ID NO: 82165 - DNA, 15 bp, Homo sapiens
gaaaagaacgaggcc

SEQ ID NO: 82166 - DNA, 15 bp, Homo sapiens
aaaagaacgaggcca

SEQ ID NO: 82167 - DNA, 15 bp, Homo sapiens
aaagaacgaggccat

SEQ ID NO: 82168 - DNA, 15 bp, Homo sapiens
aagaacgaggccatt

SEQ ID NO: 82169 - DNA, 15 bp, Homo sapiens
agaacgaggccattc

SEQ ID NO: 82170 - DNA, 15 bp, Homo sapiens
gaacgaggccattct

SEQ ID NO: 82171 - DNA, 15 bp, Homo sapiens
aacgaggccattctc

SEQ ID NO: 82172 - DNA, 15 bp, Homo sapiens
acgaggccattctca

SEQ ID NO: 82173 - DNA, 15 bp, Homo sapiens
cgaggccattctcag

SEQ ID NO: 82174 - DNA, 15 bp, Homo sapiens
gaggccattctcagt

SEQ ID NO: 82175 - DNA, 15 bp, Homo sapiens
aggccattctcagtc

SEQ ID NO: 82176 - DNA, 15 bp, Homo sapiens
ggccattctcagtcc

SEQ ID NO: 82177 - DNA, 15 bp, Homo sapiens
gccattctcagtcct

SEQ ID NO: 82178 - DNA, 15 bp, Homo sapiens
ccattctcagtcctt

SEQ ID NO: 82179 - DNA, 15 bp, Homo sapiens
cattctcagtccttg

SEQ ID NO: 82180 - DNA, 15 bp, Homo sapiens
attctcagtccttgc

SEQ ID NO: 82181 - DNA, 15 bp, Homo sapiens
ttctcagtccttgct

SEQ ID NO: 82182 - DNA, 15 bp, Homo sapiens
tctcagtccttgctt

SEQ ID NO: 82183 - DNA, 15 bp, Homo sapiens
ctcagtccttgcttt

SEQ ID NO: 82184 - DNA, 15 bp, Homo sapiens
tcagtccttgctttt

SEQ ID NO: 82185 - DNA, 15 bp, Homo sapiens
cagtccttgcttttg

SEQ ID NO: 82186 - DNA, 15 bp, Homo sapiens
agtccttgcttttgg

SEQ ID NO: 82187 - DNA, 15 bp, Homo sapiens
gtccttgcttttggc

SEQ ID NO: 82188 - DNA, 15 bp, Homo sapiens
tccttgcttttggca

SEQ ID NO: 82189 - DNA, 15 bp, Homo sapiens
ccttgcttttggcag

SEQ ID NO: 82190 - DNA, 15 bp, Homo sapiens
cttgcttttggcagc

SEQ ID NO: 82191 - DNA, 15 bp, Homo sapiens
ttgcttttggcagcc

SEQ ID NO: 82192 - DNA, 15 bp, Homo sapiens
tgcttttggcagccg

SEQ ID NO: 82193 - DNA, 15 bp, Homo sapiens
gcttttggcagccgc

SEQ ID NO: 82194 - DNA, 15 bp, Homo sapiens
cttttggcagccgcg

SEQ ID NO: 82195 - DNA, 15 bp, Homo sapiens
ttttggcagccgcgc

SEQ ID NO: 82196 - DNA, 15 bp, Homo sapiens
tttggcagccgcgct

SEQ ID NO: 82197 - DNA, 15 bp, Homo sapiens
ttggcagccgcgctt

SEQ ID NO: 82198 - DNA, 15 bp, Homo sapiens
tggcagccgcgcttc

SEQ ID NO: 82199 - DNA, 15 bp, Homo sapiens
ggcagccgcgcttct

SEQ ID NO: 82200 - DNA, 15 bp, Homo sapiens
gcagccgcgcttctc

SEQ ID NO: 82201 - DNA, 15 bp, Homo sapiens
cagccgcgcttctca

SEQ ID NO: 82202 - DNA, 15 bp, Homo sapiens
agccgcgcttctcag

SEQ ID NO: 82203 - DNA, 15 bp, Homo sapiens
gccgcgcttctcagc

SEQ ID NO: 82204 - DNA, 15 bp, Homo sapiens
ccgcgcttctcagca

SEQ ID NO: 82205 - DNA, 15 bp, Homo sapiens
cgcgcttctcagcac

SEQ ID NO: 82206 - DNA, 15 bp, Homo sapiens
gcgcttctcagcact

SEQ ID NO: 82207 - DNA, 15 bp, Homo sapiens
cgcttctcagcactc

SEQ ID NO: 82208 - DNA, 15 bp, Homo sapiens
gcttctcagcactcc

SEQ ID NO: 82209 - DNA, 15 bp, Homo sapiens
cttctcagcactccc

SEQ ID NO: 82210 - DNA, 15 bp, Homo sapiens
ttctcagcactccct

SEQ ID NO: 82211 - DNA, 15 bp, Homo sapiens
tctcagcactccctg

SEQ ID NO: 82212 - DNA, 15 bp, Homo sapiens
ctcagcactccctgt

SEQ ID NO: 82213 - DNA, 15 bp, Homo sapiens
tcagcactccctgtg

SEQ ID NO: 82214 - DNA, 15 bp, Homo sapiens
cagcactccctgtga

SEQ ID NO: 82215 - DNA, 15 bp, Homo sapiens
agcactccctgtgat

SEQ ID NO: 82216 - DNA, 15 bp, Homo sapiens
gcactccctgtgatg

SEQ ID NO: 82217 - DNA, 15 bp, Homo sapiens
cactccctgtgatgg

SEQ ID NO: 82218 - DNA, 15 bp, Homo sapiens
actccctgtgatggg

SEQ ID NO: 82219 - DNA, 15 bp, Homo sapiens
ctccctgtgatggga

SEQ ID NO: 82220 - DNA, 15 bp, Homo sapiens
tccctgtgatgggaa

SEQ ID NO: 82221 - DNA, 15 bp, Homo sapiens
ccctgtgatgggaac

SEQ ID NO: 82222 - DNA, 15 bp, Homo sapiens
cctgtgatgggaaca

SEQ ID NO: 82223 - DNA, 15 bp, Homo sapiens
ctgtgatgggaacag

SEQ ID NO: 82224 - DNA, 15 bp, Homo sapiens
tgtgatgggaacaga

SEQ ID NO: 82225 - DNA, 15 bp, Homo sapiens
gtgatgggaacagag

SEQ ID NO: 82226 - DNA, 15 bp, Homo sapiens
tgatgggaacagagg

SEQ ID NO: 82227 - DNA, 15 bp, Homo sapiens
gatgggaacagaggg

SEQ ID NO: 82228 - DNA, 15 bp, Homo sapiens
atgggaacagagggg

SEQ ID NO: 82229 - DNA, 15 bp, Homo sapiens
tgggaacagaggggc

SEQ ID NO: 82230 - DNA, 15 bp, Homo sapiens
gggaacagaggggcg

SEQ ID NO: 82231 - DNA, 15 bp, Homo sapiens
ggaacagaggggcga

SEQ ID NO: 82232 - DNA, 15 bp, Homo sapiens
gaacagaggggcgag

SEQ ID NO: 82233 - DNA, 15 bp, Homo sapiens
aacagaggggcgagg

SEQ ID NO: 82234 - DNA, 15 bp, Homo sapiens
acagaggggcgaggg

SEQ ID NO: 82235 - DNA, 15 bp, Homo sapiens
cagaggggcgagggg

SEQ ID NO: 82236 - DNA, 15 bp, Homo sapiens
agaggggcgaggggc

SEQ ID NO: 82237 - DNA, 15 bp, Homo sapiens
gaggggcgaggggca

SEQ ID NO: 82238 - DNA, 15 bp, Homo sapiens
aggggcgaggggcag

SEQ ID NO: 82239 - DNA, 15 bp, Homo sapiens
ggggcgaggggcaga

SEQ ID NO: 82240 - DNA, 15 bp, Homo sapiens
gggcgaggggcagag

SEQ ID NO: 82241 - DNA, 15 bp, Homo sapiens
ggcgaggggcagagc

SEQ ID NO: 82242 - DNA, 15 bp, Homo sapiens
gcgaggggcagagcg

SEQ ID NO: 82243 - DNA, 15 bp, Homo sapiens
cgaggggcagagcgt

SEQ ID NO: 82244 - DNA, 15 bp, Homo sapiens
gaggggcagagcgtt

SEQ ID NO: 82245 - DNA, 15 bp, Homo sapiens
aggggcagagcgttc

SEQ ID NO: 82246 - DNA, 15 bp, Homo sapiens
ggggcagagcgttcc

SEQ ID NO: 82247 - DNA, 15 bp, Homo sapiens
gggcagagcgttccc

SEQ ID NO: 82248 - DNA, 15 bp, Homo sapiens
ggcagagcgttccca

SEQ ID NO: 82249 - DNA, 15 bp, Homo sapiens
gcagagcgttcccag

SEQ ID NO: 82250 - DNA, 15 bp, Homo sapiens
cagagcgttcccagc

SEQ ID NO: 82251 - DNA, 15 bp, Homo sapiens
agagcgttcccagct

SEQ ID NO: 82252 - DNA, 15 bp, Homo sapiens
gagcgttcccagctg

SEQ ID NO: 82253 - DNA, 15 bp, Homo sapiens
agcgttcccagctgc

SEQ ID NO: 82254 - DNA, 15 bp, Homo sapiens
gcgttcccagctgca

SEQ ID NO: 82255 - DNA, 15 bp, Homo sapiens
cgttcccagctgcag

SEQ ID NO: 82256 - DNA, 15 bp, Homo sapiens
gttcccagctgcagg

SEQ ID NO: 82257 - DNA, 15 bp, Homo sapiens
ttcccagctgcaggg

SEQ ID NO: 82258 - DNA, 15 bp, Homo sapiens
tcccagctgcagggt

SEQ ID NO: 82259 - DNA, 15 bp, Homo sapiens
cccagctgcagggta

SEQ ID NO: 82260 - DNA, 15 bp, Homo sapiens
ccagctgcagggtat

SEQ ID NO: 82261 - DNA, 15 bp, Homo sapiens
cagctgcagggtatg

SEQ ID NO: 82262 - DNA, 15 bp, Homo sapiens
agctgcagggtatgt

SEQ ID NO: 82263 - DNA, 15 bp, Homo sapiens
gctgcagggtatgtc

SEQ ID NO: 82264 - DNA, 15 bp, Homo sapiens
ctgcagggtatgtca

SEQ ID NO: 82265 - DNA, 15 bp, Homo sapiens
tgcagggtatgtcat

SEQ ID NO: 82266 - DNA, 15 bp, Homo sapiens
gcagggtatgtcatt

SEQ ID NO: 82267 - DNA, 15 bp, Homo sapiens
cagggtatgtcattt

SEQ ID NO: 82268 - DNA, 15 bp, Homo sapiens
agggtatgtcatttt

SEQ ID NO: 82269 - DNA, 15 bp, Homo sapiens
gggtatgtcatttta

SEQ ID NO: 82270 - DNA, 15 bp, Homo sapiens
ggtatgtcattttag

SEQ ID NO: 82271 - DNA, 15 bp, Homo sapiens
gtatgtcattttaga

SEQ ID NO: 82272 - DNA, 15 bp, Homo sapiens
tatgtcattttagag

SEQ ID NO: 82273 - DNA, 15 bp, Homo sapiens
atgtcattttagagc

SEQ ID NO: 82274 - DNA, 15 bp, Homo sapiens
tgtcattttagagcc

SEQ ID NO: 82275 - DNA, 15 bp, Homo sapiens
gtcattttagagccc

SEQ ID NO: 82276 - DNA, 15 bp, Homo sapiens
tcattttagagccct

SEQ ID NO: 82277 - DNA, 15 bp, Homo sapiens
cattttagagccctg

SEQ ID NO: 82278 - DNA, 15 bp, Homo sapiens
attttagagccctgg

SEQ ID NO: 82279 - DNA, 15 bp, Homo sapiens
ttttagagccctggg

SEQ ID NO: 82280 - DNA, 15 bp, Homo sapiens
tttagagccctgggg

SEQ ID NO: 82281 - DNA, 15 bp, Homo sapiens
ttagagccctggggc

SEQ ID NO: 82282 - DNA, 15 bp, Homo sapiens
tagagccctggggca

SEQ ID NO: 82283 - DNA, 15 bp, Homo sapiens
agagccctggggcag

SEQ ID NO: 82284 - DNA, 15 bp, Homo sapiens
gagccctggggcagg

SEQ ID NO: 82285 - DNA, 15 bp, Homo sapiens
agccctggggcaggt

SEQ ID NO: 82286 - DNA, 15 bp, Homo sapiens
gccctggggcaggtc

SEQ ID NO: 82287 - DNA, 15 bp, Homo sapiens
ccctggggcaggtca

SEQ ID NO: 82288 - DNA, 15 bp, Homo sapiens
cctggggcaggtcac

SEQ ID NO: 82289 - DNA, 15 bp, Homo sapiens
ctggggcaggtcacg

SEQ ID NO: 82290 - DNA, 15 bp, Homo sapiens
tggggcaggtcacgg

SEQ ID NO: 82291 - DNA, 15 bp, Homo sapiens
ggggcaggtcacgga

SEQ ID NO: 82292 - DNA, 15 bp, Homo sapiens
gggcaggtcacggac

SEQ ID NO: 82293 - DNA, 15 bp, Homo sapiens
ggcaggtcacggacg

SEQ ID NO: 82294 - DNA, 15 bp, Homo sapiens
gcaggtcacggacgg

SEQ ID NO: 82295 - DNA, 15 bp, Homo sapiens
caggtcacggacggc

SEQ ID NO: 82296 - DNA, 15 bp, Homo sapiens
aggtcacggacggcc

SEQ ID NO: 82297 - DNA, 15 bp, Homo sapiens
ggtcacggacggcct

SEQ ID NO: 82298 - DNA, 15 bp, Homo sapiens
gtcacggacggcctg

SEQ ID NO: 82299 - DNA, 15 bp, Homo sapiens
tcacggacggcctgg

SEQ ID NO: 82300 - DNA, 15 bp, Homo sapiens
cacggacggcctgga

SEQ ID NO: 82301 - DNA, 15 bp, Homo sapiens
acggacggcctggag

SEQ ID NO: 82302 - DNA, 15 bp, Homo sapiens
cggacggcctggagc

SEQ ID NO: 82303 - DNA, 15 bp, Homo sapiens
ggacggcctggagca

SEQ ID NO: 82304 - DNA, 15 bp, Homo sapiens
gacggcctggagcag

SEQ ID NO: 82305 - DNA, 15 bp, Homo sapiens
acggcctggagcagc

SEQ ID NO: 82306 - DNA, 15 bp, Homo sapiens
cggcctggagcagcc

SEQ ID NO: 82307 - DNA, 15 bp, Homo sapiens
ggcctggagcagccc

SEQ ID NO: 82308 - DNA, 15 bp, Homo sapiens
gcctggagcagccct

SEQ ID NO: 82309 - DNA, 15 bp, Homo sapiens
cctggagcagccctg

SEQ ID NO: 82310 - DNA, 15 bp, Homo sapiens
ctggagcagccctgt

SEQ ID NO: 82311 - DNA, 15 bp, Homo sapiens
tggagcagccctgtg

SEQ ID NO: 82312 - DNA, 15 bp, Homo sapiens
ggagcagccctgtgg

SEQ ID NO: 82313 - DNA, 15 bp, Homo sapiens
gagcagccctgtggt

SEQ ID NO: 82314 - DNA, 15 bp, Homo sapiens
agcagccctgtggtt

SEQ ID NO: 82315 - DNA, 15 bp, Homo sapiens
gcagccctgtggttt

SEQ ID NO: 82316 - DNA, 15 bp, Homo sapiens
cagccctgtggtttg

SEQ ID NO: 82317 - DNA, 15 bp, Homo sapiens
agccctgtggtttgc

SEQ ID NO: 82318 - DNA, 15 bp, Homo sapiens
gccctgtggtttgcc

SEQ ID NO: 82319 - DNA, 15 bp, Homo sapiens
ccctgtggtttgccc

SEQ ID NO: 82320 - DNA, 15 bp, Homo sapiens
cctgtggtttgccca

SEQ ID NO: 82321 - DNA, 15 bp, Homo sapiens
ctgtggtttgcccac

SEQ ID NO: 82322 - DNA, 15 bp, Homo sapiens
tgtggtttgcccacg

SEQ ID NO: 82323 - DNA, 15 bp, Homo sapiens
gtggtttgcccacgg

SEQ ID NO: 82324 - DNA, 15 bp, Homo sapiens
tggtttgcccacggg

SEQ ID NO: 82325 - DNA, 15 bp, Homo sapiens
ggtttgcccacgggg

SEQ ID NO: 82326 - DNA, 15 bp, Homo sapiens
gtttgcccacggggt

SEQ ID NO: 82327 - DNA, 15 bp, Homo sapiens
tttgcccacggggtg

SEQ ID NO: 82328 - DNA, 15 bp, Homo sapiens
ttgcccacggggtga

SEQ ID NO: 82329 - DNA, 15 bp, Homo sapiens
tgcccacggggtgac

SEQ ID NO: 82330 - DNA, 15 bp, Homo sapiens
gcccacggggtgacc

SEQ ID NO: 82331 - DNA, 15 bp, Homo sapiens
cccacggggtgaccg

SEQ ID NO: 82332 - DNA, 15 bp, Homo sapiens
ccacggggtgaccgg

SEQ ID NO: 82333 - DNA, 15 bp, Homo sapiens
cacggggtgaccggc

SEQ ID NO: 82334 - DNA, 15 bp, Homo sapiens
acggggtgaccggcc

SEQ ID NO: 82335 - DNA, 15 bp, Homo sapiens
cggggtgaccggcca

SEQ ID NO: 82336 - DNA, 15 bp, Homo sapiens
ggggtgaccggccag

SEQ ID NO: 82337 - DNA, 15 bp, Homo sapiens
gggtgaccggccagg

SEQ ID NO: 82338 - DNA, 15 bp, Homo sapiens
ggtgaccggccaggg

SEQ ID NO: 82339 - DNA, 15 bp, Homo sapiens
gtgaccggccagggc

SEQ ID NO: 82340 - DNA, 15 bp, Homo sapiens
tgaccggccagggct

SEQ ID NO: 82341 - DNA, 15 bp, Homo sapiens
gaccggccagggctg

SEQ ID NO: 82342 - DNA, 15 bp, Homo sapiens
accggccagggctgc

SEQ ID NO: 82343 - DNA, 15 bp, Homo sapiens
ccggccagggctgcc

SEQ ID NO: 82344 - DNA, 15 bp, Homo sapiens
cggccagggctgcca

SEQ ID NO: 82345 - DNA, 15 bp, Homo sapiens
ggccagggctgccat

SEQ ID NO: 82346 - DNA, 15 bp, Homo sapiens
gccagggctgccatc

SEQ ID NO: 82347 - DNA, 15 bp, Homo sapiens
ccagggctgccatct

SEQ ID NO: 82348 - DNA, 15 bp, Homo sapiens
cagggctgccatctc

SEQ ID NO: 82349 - DNA, 15 bp, Homo sapiens
agggctgccatctca

SEQ ID NO: 82350 - DNA, 15 bp, Homo sapiens
gggctgccatctcac

SEQ ID NO: 82351 - DNA, 15 bp, Homo sapiens
ggctgccatctcacc

SEQ ID NO: 82352 - DNA, 15 bp, Homo sapiens
gctgccatctcaccc

SEQ ID NO: 82353 - DNA, 15 bp, Homo sapiens
ctgccatctcaccct

SEQ ID NO: 82354 - DNA, 15 bp, Homo sapiens
tgccatctcaccctg

SEQ ID NO: 82355 - DNA, 15 bp, Homo sapiens
gccatctcaccctga

SEQ ID NO: 82356 - DNA, 15 bp, Homo sapiens
ccatctcaccctgag

SEQ ID NO: 82357 - DNA, 15 bp, Homo sapiens
catctcaccctgaga

SEQ ID NO: 82358 - DNA, 15 bp, Homo sapiens
atctcaccctgagag

SEQ ID NO: 82359 - DNA, 15 bp, Homo sapiens
tctcaccctgagagt

SEQ ID NO: 82360 - DNA, 15 bp, Homo sapiens
ctcaccctgagagtc

SEQ ID NO: 82361 - DNA, 15 bp, Homo sapiens
tcaccctgagagtcc

SEQ ID NO: 82362 - DNA, 15 bp, Homo sapiens
caccctgagagtccc

SEQ ID NO: 82363 - DNA, 15 bp, Homo sapiens
accctgagagtccct

SEQ ID NO: 82364 - DNA, 15 bp, Homo sapiens
ccctgagagtccctc

SEQ ID NO: 82365 - DNA, 15 bp, Homo sapiens
cctgagagtccctct

SEQ ID NO: 82366 - DNA, 15 bp, Homo sapiens
ctgagagtccctctt

SEQ ID NO: 82367 - DNA, 15 bp, Homo sapiens
tgagagtccctcttt

SEQ ID NO: 82368 - DNA, 15 bp, Homo sapiens
gagagtccctctttt

SEQ ID NO: 82369 - DNA, 15 bp, Homo sapiens
agagtccctcttttc

SEQ ID NO: 82370 - DNA, 15 bp, Homo sapiens
gagtccctcttttcc

SEQ ID NO: 82371 - DNA, 15 bp, Homo sapiens
agtccctcttttcca

SEQ ID NO: 82372 - DNA, 15 bp, Homo sapiens
gtccctcttttccac

SEQ ID NO: 82373 - DNA, 15 bp, Homo sapiens
tccctcttttccact

SEQ ID NO: 82374 - DNA, 15 bp, Homo sapiens
ccctcttttccactt

SEQ ID NO: 82375 - DNA, 15 bp, Homo sapiens
cctcttttccacttg

SEQ ID NO: 82376 - DNA, 15 bp, Homo sapiens
ctcttttccacttgc

SEQ ID NO: 82377 - DNA, 15 bp, Homo sapiens
tcttttccacttgca

SEQ ID NO: 82378 - DNA, 15 bp, Homo sapiens
cttttccacttgcag

SEQ ID NO: 82379 - DNA, 15 bp, Homo sapiens
ttttccacttgcagg

SEQ ID NO: 82380 - DNA, 15 bp, Homo sapiens
tttccacttgcaggt

SEQ ID NO: 82381 - DNA, 15 bp, Homo sapiens
ttccacttgcaggtg

SEQ ID NO: 82382 - DNA, 15 bp, Homo sapiens
tccacttgcaggtgt

SEQ ID NO: 82383 - DNA, 15 bp, Homo sapiens
ccacttgcaggtgta

SEQ ID NO: 82384 - DNA, 15 bp, Homo sapiens
cacttgcaggtgtac

SEQ ID NO: 82385 - DNA, 15 bp, Homo sapiens
acttgcaggtgtacg

SEQ ID NO: 82386 - DNA, 15 bp, Homo sapiens
cttgcaggtgtacga

SEQ ID NO: 82387 - DNA, 15 bp, Homo sapiens
ttgcaggtgtacgag

SEQ ID NO: 82388 - DNA, 15 bp, Homo sapiens
tgcaggtgtacgaga

SEQ ID NO: 82389 - DNA, 15 bp, Homo sapiens
gcaggtgtacgagag

SEQ ID NO: 82390 - DNA, 15 bp, Homo sapiens
caggtgtacgagagg

SEQ ID NO: 82391 - DNA, 15 bp, Homo sapiens
aggtgtacgagaggc

SEQ ID NO: 82392 - DNA, 15 bp, Homo sapiens
ggtgtacgagaggct

SEQ ID NO: 82393 - DNA, 15 bp, Homo sapiens
gtgtacgagaggcta

SEQ ID NO: 82394 - DNA, 15 bp, Homo sapiens
tgtacgagaggctag

SEQ ID NO: 82395 - DNA, 15 bp, Homo sapiens
gtacgagaggctaga

SEQ ID NO: 82396 - DNA, 15 bp, Homo sapiens
tacgagaggctagag

SEQ ID NO: 82397 - DNA, 15 bp, Homo sapiens
acgagaggctagaga

SEQ ID NO: 82398 - DNA, 15 bp, Homo sapiens
cgagaggctagagaa

SEQ ID NO: 82399 - DNA, 15 bp, Homo sapiens
gagaggctagagaag

SEQ ID NO: 82400 - DNA, 15 bp, Homo sapiens
agaggctagagaagc

SEQ ID NO: 82401 - DNA, 15 bp, Homo sapiens
gaggctagagaagct

SEQ ID NO: 82402 - DNA, 15 bp, Homo sapiens
aggctagagaagctg

SEQ ID NO: 82403 - DNA, 15 bp, Homo sapiens
ggctagagaagctgc

SEQ ID NO: 82404 - DNA, 15 bp, Homo sapiens
gctagagaagctgca

SEQ ID NO: 82405 - DNA, 15 bp, Homo sapiens
ctagagaagctgcag

SEQ ID NO: 82406 - DNA, 15 bp, Homo sapiens
tagagaagctgcagg

SEQ ID NO: 82407 - DNA, 15 bp, Homo sapiens
agagaagctgcaggc

SEQ ID NO: 82408 - DNA, 15 bp, Homo sapiens
gagaagctgcaggca

SEQ ID NO: 82409 - DNA, 15 bp, Homo sapiens
agaagctgcaggcag

SEQ ID NO: 82410 - DNA, 15 bp, Homo sapiens
gaagctgcaggcagt

SEQ ID NO: 82411 - DNA, 15 bp, Homo sapiens
aagctgcaggcagtg

SEQ ID NO: 82412 - DNA, 15 bp, Homo sapiens
agctgcaggcagtgg

SEQ ID NO: 82413 - DNA, 15 bp, Homo sapiens
gctgcaggcagtggt

SEQ ID NO: 82414 - DNA, 15 bp, Homo sapiens
ctgcaggcagtggtg

SEQ ID NO: 82415 - DNA, 15 bp, Homo sapiens
tgcaggcagtggtgg

SEQ ID NO: 82416 - DNA, 15 bp, Homo sapiens
gcaggcagtggtggc

SEQ ID NO: 82417 - DNA, 15 bp, Homo sapiens
caggcagtggtggcg

SEQ ID NO: 82418 - DNA, 15 bp, Homo sapiens
aggcagtggtggcgg

SEQ ID NO: 82419 - DNA, 15 bp, Homo sapiens
ggcagtggtggcggg

SEQ ID NO: 82420 - DNA, 15 bp, Homo sapiens
gcagtggtggcgggg

SEQ ID NO: 82421 - DNA, 15 bp, Homo sapiens
cagtggtggcggggg

SEQ ID NO: 82422 - DNA, 15 bp, Homo sapiens
agtggtggcgggggt

SEQ ID NO: 82423 - DNA, 15 bp, Homo sapiens
gtggtggcgggggtg

SEQ ID NO: 82424 - DNA, 15 bp, Homo sapiens
tggtggcgggggtgc

SEQ ID NO: 82425 - DNA, 15 bp, Homo sapiens
ggtggcgggggtgcc

SEQ ID NO: 82426 - DNA, 15 bp, Homo sapiens
gtggcgggggtgccc

SEQ ID NO: 82427 - DNA, 15 bp, Homo sapiens
tggcgggggtgcccg

SEQ ID NO: 82428 - DNA, 15 bp, Homo sapiens
ggcgggggtgcccgg

SEQ ID NO: 82429 - DNA, 15 bp, Homo sapiens
gcgggggtgcccggg

SEQ ID NO: 82430 - DNA, 15 bp, Homo sapiens
cgggggtgcccgggc

SEQ ID NO: 82431 - DNA, 15 bp, Homo sapiens
gggggtgcccgggca

SEQ ID NO: 82432 - DNA, 15 bp, Homo sapiens
ggggtgcccgggcat

SEQ ID NO: 82433 - DNA, 15 bp, Homo sapiens
gggtgcccgggcatt

SEQ ID NO: 82434 - DNA, 15 bp, Homo sapiens
ggtgcccgggcattc

SEQ ID NO: 82435 - DNA, 15 bp, Homo sapiens
gtgcccgggcattcg

SEQ ID NO: 82436 - DNA, 15 bp, Homo sapiens
tgcccgggcattcgg

SEQ ID NO: 82437 - DNA, 15 bp, Homo sapiens
gcccgggcattcgga

SEQ ID NO: 82438 - DNA, 15 bp, Homo sapiens
cccgggcattcggag

SEQ ID NO: 82439 - DNA, 15 bp, Homo sapiens
ccgggcattcggagg

SEQ ID NO: 82440 - DNA, 15 bp, Homo sapiens
cgggcattcggaggc

SEQ ID NO: 82441 - DNA, 15 bp, Homo sapiens
gggcattcggaggcc

SEQ ID NO: 82442 - DNA, 15 bp, Homo sapiens
ggcattcggaggccg

SEQ ID NO: 82443 - DNA, 15 bp, Homo sapiens
gcattcggaggccgc

SEQ ID NO: 82444 - DNA, 15 bp, Homo sapiens
cattcggaggccgcc

SEQ ID NO: 82445 - DNA, 15 bp, Homo sapiens
attcggaggccgcca

SEQ ID NO: 82446 - DNA, 15 bp, Homo sapiens
ttcggaggccgccag

SEQ ID NO: 82447 - DNA, 15 bp, Homo sapiens
tcggaggccgccagc

SEQ ID NO: 82448 - DNA, 15 bp, Homo sapiens
cggaggccgccagct

SEQ ID NO: 82449 - DNA, 15 bp, Homo sapiens
ggaggccgccagctg

SEQ ID NO: 82450 - DNA, 15 bp, Homo sapiens
gaggccgccagctgc

SEQ ID NO: 82451 - DNA, 15 bp, Homo sapiens
aggccgccagctgca

SEQ ID NO: 82452 - DNA, 15 bp, Homo sapiens
ggccgccagctgcat

SEQ ID NO: 82453 - DNA, 15 bp, Homo sapiens
gccgccagctgcatc

SEQ ID NO: 82454 - DNA, 15 bp, Homo sapiens
ccgccagctgcatcc

SEQ ID NO: 82455 - DNA, 15 bp, Homo sapiens
cgccagctgcatccc

SEQ ID NO: 82456 - DNA, 15 bp, Homo sapiens
gccagctgcatcccc

SEQ ID NO: 82457 - DNA, 15 bp, Homo sapiens
ccagctgcatccccc

SEQ ID NO: 82458 - DNA, 15 bp, Homo sapiens
cagctgcatcccccc

SEQ ID NO: 82459 - DNA, 15 bp, Homo sapiens
agctgcatcccccct

SEQ ID NO: 82460 - DNA, 15 bp, Homo sapiens
gctgcatcccccctt

SEQ ID NO: 82461 - DNA, 15 bp, Homo sapiens
ctgcatccccccttc

SEQ ID NO: 82462 - DNA, 15 bp, Homo sapiens
tgcatccccccttcc

SEQ ID NO: 82463 - DNA, 15 bp, Homo sapiens
gcatccccccttccc

SEQ ID NO: 82464 - DNA, 15 bp, Homo sapiens
catccccccttcccc

SEQ ID NO: 82465 - DNA, 15 bp, Homo sapiens
atccccccttccccg

SEQ ID NO: 82466 - DNA, 15 bp, Homo sapiens
tccccccttccccgc

SEQ ID NO: 82467 - DNA, 15 bp, Homo sapiens
ccccccttccccgca

SEQ ID NO: 82468 - DNA, 15 bp, Homo sapiens
cccccttccccgcag

SEQ ID NO: 82469 - DNA, 15 bp, Homo sapiens
ccccttccccgcagg

SEQ ID NO: 82470 - DNA, 15 bp, Homo sapiens
cccttccccgcagga

SEQ ID NO: 82471 - DNA, 15 bp, Homo sapiens
ccttccccgcaggag

SEQ ID NO: 82472 - DNA, 15 bp, Homo sapiens
cttccccgcaggaga

SEQ ID NO: 82473 - DNA, 15 bp, Homo sapiens
ttccccgcaggagaa

SEQ ID NO: 82474 - DNA, 15 bp, Homo sapiens
tccccgcaggagaac

SEQ ID NO: 82475 - DNA, 15 bp, Homo sapiens
ccccgcaggagaact

SEQ ID NO: 82476 - DNA, 15 bp, Homo sapiens
cccgcaggagaactc

SEQ ID NO: 82477 - DNA, 15 bp, Homo sapiens
ccgcaggagaactcc

SEQ ID NO: 82478 - DNA, 15 bp, Homo sapiens
cgcaggagaactcct

SEQ ID NO: 82479 - DNA, 15 bp, Homo sapiens
gcaggagaactccta

SEQ ID NO: 82480 - DNA, 15 bp, Homo sapiens
caggagaactcctac

SEQ ID NO: 82481 - DNA, 15 bp, Homo sapiens
aggagaactcctacg

SEQ ID NO: 82482 - DNA, 15 bp, Homo sapiens
ggagaactcctacgt

SEQ ID NO: 82483 - DNA, 15 bp, Homo sapiens
gagaactcctacgtg

SEQ ID NO: 82484 - DNA, 15 bp, Homo sapiens
agaactcctacgtgt

SEQ ID NO: 82485 - DNA, 15 bp, Homo sapiens
gaactcctacgtgtc

SEQ ID NO: 82486 - DNA, 15 bp, Homo sapiens
aactcctacgtgtcc

SEQ ID NO: 82487 - DNA, 15 bp, Homo sapiens
actcctacgtgtcca

SEQ ID NO: 82488 - DNA, 15 bp, Homo sapiens
ctcctacgtgtccag

SEQ ID NO: 82489 - DNA, 15 bp, Homo sapiens
tcctacgtgtccagc

SEQ ID NO: 82490 - DNA, 15 bp, Homo sapiens
cctacgtgtccagca

SEQ ID NO: 82491 - DNA, 15 bp, Homo sapiens
ctacgtgtccagcac

SEQ ID NO: 82492 - DNA, 15 bp, Homo sapiens
tacgtgtccagcact

SEQ ID NO: 82493 - DNA, 15 bp, Homo sapiens
acgtgtccagcactg

SEQ ID NO: 82494 - DNA, 15 bp, Homo sapiens
cgtgtccagcactgg

SEQ ID NO: 82495 - DNA, 15 bp, Homo sapiens
gtgtccagcactggc

SEQ ID NO: 82496 - DNA, 15 bp, Homo sapiens
tgtccagcactggca

SEQ ID NO: 82497 - DNA, 15 bp, Homo sapiens
gtccagcactggcag

SEQ ID NO: 82498 - DNA, 15 bp, Homo sapiens
tccagcactggcaga

SEQ ID NO: 82499 - DNA, 15 bp, Homo sapiens
ccagcactggcagag

SEQ ID NO: 82500 - DNA, 15 bp, Homo sapiens
cagcactggcagagc

SEQ ID NO: 82501 - DNA, 15 bp, Homo sapiens
agcactggcagagcc

SEQ ID NO: 82502 - DNA, 15 bp, Homo sapiens
gcactggcagagccc

SEQ ID NO: 82503 - DNA, 15 bp, Homo sapiens
cactggcagagccca

SEQ ID NO: 82504 - DNA, 15 bp, Homo sapiens
actggcagagcccac

SEQ ID NO: 82505 - DNA, 15 bp, Homo sapiens
ctggcagagcccaca

SEQ ID NO: 82506 - DNA, 15 bp, Homo sapiens
tggcagagcccacag

SEQ ID NO: 82507 - DNA, 15 bp, Homo sapiens
ggcagagcccacagt

SEQ ID NO: 82508 - DNA, 15 bp, Homo sapiens
gcagagcccacagtg

SEQ ID NO: 82509 - DNA, 15 bp, Homo sapiens
cagagcccacagtgg

SEQ ID NO: 82510 - DNA, 15 bp, Homo sapiens
agagcccacagtggg

SEQ ID NO: 82511 - DNA, 15 bp, Homo sapiens
gagcccacagtgggg

SEQ ID NO: 82512 - DNA, 15 bp, Homo sapiens
agcccacagtggggc

SEQ ID NO: 82513 - DNA, 15 bp, Homo sapiens
gcccacagtggggct

SEQ ID NO: 82514 - DNA, 15 bp, Homo sapiens
cccacagtggggctg

SEQ ID NO: 82515 - DNA, 15 bp, Homo sapiens
ccacagtggggctgc

SEQ ID NO: 82516 - DNA, 15 bp, Homo sapiens
cacagtggggctgct

SEQ ID NO: 82517 - DNA, 15 bp, Homo sapiens
acagtggggctgctc

SEQ ID NO: 82518 - DNA, 15 bp, Homo sapiens
cagtggggctgctcc

SEQ ID NO: 82519 - DNA, 15 bp, Homo sapiens
agtggggctgctcca

SEQ ID NO: 82520 - DNA, 15 bp, Homo sapiens
gtggggctgctccat

SEQ ID NO: 82521 - DNA, 15 bp, Homo sapiens
tggggctgctccatg

SEQ ID NO: 82522 - DNA, 15 bp, Homo sapiens
ggggctgctccatgg

SEQ ID NO: 82523 - DNA, 15 bp, Homo sapiens
gggctgctccatggc

SEQ ID NO: 82524 - DNA, 15 bp, Homo sapiens
ggctgctccatggca

SEQ ID NO: 82525 - DNA, 15 bp, Homo sapiens
gctgctccatggcag

SEQ ID NO: 82526 - DNA, 15 bp, Homo sapiens
ctgctccatggcagc

SEQ ID NO: 82527 - DNA, 15 bp, Homo sapiens
tgctccatggcagcc

SEQ ID NO: 82528 - DNA, 15 bp, Homo sapiens
gctccatggcagccc

SEQ ID NO: 82529 - DNA, 15 bp, Homo sapiens
ctccatggcagcccc

SEQ ID NO: 82530 - DNA, 15 bp, Homo sapiens
tccatggcagcccct

SEQ ID NO: 82531 - DNA, 15 bp, Homo sapiens
ccatggcagcccctg

SEQ ID NO: 82532 - DNA, 15 bp, Homo sapiens
catggcagcccctgg

SEQ ID NO: 82533 - DNA, 15 bp, Homo sapiens
atggcagcccctggc

SEQ ID NO: 82534 - DNA, 15 bp, Homo sapiens
tggcagcccctggca

SEQ ID NO: 82535 - DNA, 15 bp, Homo sapiens
ggcagcccctggcag

SEQ ID NO: 82536 - DNA, 15 bp, Homo sapiens
gcagcccctggcagc

SEQ ID NO: 82537 - DNA, 15 bp, Homo sapiens
cagcccctggcagcg

SEQ ID NO: 82538 - DNA, 15 bp, Homo sapiens
agcccctggcagcgc

SEQ ID NO: 82539 - DNA, 15 bp, Homo sapiens
gcccctggcagcgcc

SEQ ID NO: 82540 - DNA, 15 bp, Homo sapiens
cccctggcagcgcca

SEQ ID NO: 82541 - DNA, 15 bp, Homo sapiens
ccctggcagcgccat

SEQ ID NO: 82542 - DNA, 15 bp, Homo sapiens
cctggcagcgccatc

SEQ ID NO: 82543 - DNA, 15 bp, Homo sapiens
ctggcagcgccatca

SEQ ID NO: 82544 - DNA, 15 bp, Homo sapiens
tggcagcgccatcag

SEQ ID NO: 82545 - DNA, 15 bp, Homo sapiens
ggcagcgccatcagg

SEQ ID NO: 82546 - DNA, 15 bp, Homo sapiens
gcagcgccatcagga

SEQ ID NO: 82547 - DNA, 15 bp, Homo sapiens
cagcgccatcaggag

SEQ ID NO: 82548 - DNA, 15 bp, Homo sapiens
agcgccatcaggagc

SEQ ID NO: 82549 - DNA, 15 bp, Homo sapiens
gcgccatcaggagcc

SEQ ID NO: 82550 - DNA, 15 bp, Homo sapiens
cgccatcaggagcca

SEQ ID NO: 82551 - DNA, 15 bp, Homo sapiens
gccatcaggagccag

SEQ ID NO: 82552 - DNA, 15 bp, Homo sapiens
ccatcaggagccagt

SEQ ID NO: 82553 - DNA, 15 bp, Homo sapiens
catcaggagccagtg

SEQ ID NO: 82554 - DNA, 15 bp, Homo sapiens
atcaggagccagtgc

SEQ ID NO: 82555 - DNA, 15 bp, Homo sapiens
tcaggagccagtgcc

SEQ ID NO: 82556 - DNA, 15 bp, Homo sapiens
caggagccagtgccc

SEQ ID NO: 82557 - DNA, 15 bp, Homo sapiens
aggagccagtgccca

SEQ ID NO: 82558 - DNA, 15 bp, Homo sapiens
ggagccagtgcccag

SEQ ID NO: 82559 - DNA, 15 bp, Homo sapiens
gagccagtgcccagg

SEQ ID NO: 82560 - DNA, 15 bp, Homo sapiens
agccagtgcccaggc

SEQ ID NO: 82561 - DNA, 15 bp, Homo sapiens
gccagtgcccaggca

SEQ ID NO: 82562 - DNA, 15 bp, Homo sapiens
ccagtgcccaggcag

SEQ ID NO: 82563 - DNA, 15 bp, Homo sapiens
cagtgcccaggcagc

SEQ ID NO: 82564 - DNA, 15 bp, Homo sapiens
agtgcccaggcagca

SEQ ID NO: 82565 - DNA, 15 bp, Homo sapiens
gtgcccaggcagcag

SEQ ID NO: 82566 - DNA, 15 bp, Homo sapiens
tgcccaggcagcaga

SEQ ID NO: 82567 - DNA, 15 bp, Homo sapiens
gcccaggcagcagag

SEQ ID NO: 82568 - DNA, 15 bp, Homo sapiens
cccaggcagcagagc

SEQ ID NO: 82569 - DNA, 15 bp, Homo sapiens
ccaggcagcagagca

SEQ ID NO: 82570 - DNA, 15 bp, Homo sapiens
caggcagcagagcag

SEQ ID NO: 82571 - DNA, 15 bp, Homo sapiens
aggcagcagagcagc

SEQ ID NO: 82572 - DNA, 15 bp, Homo sapiens
ggcagcagagcagct

SEQ ID NO: 82573 - DNA, 15 bp, Homo sapiens
gcagcagagcagctg

SEQ ID NO: 82574 - DNA, 15 bp, Homo sapiens
cagcagagcagctgc

SEQ ID NO: 82575 - DNA, 15 bp, Homo sapiens
agcagagcagctgca

SEQ ID NO: 82576 - DNA, 15 bp, Homo sapiens
gcagagcagctgcag

SEQ ID NO: 82577 - DNA, 15 bp, Homo sapiens
cagagcagctgcaga

SEQ ID NO: 82578 - DNA, 15 bp, Homo sapiens
agagcagctgcagag

SEQ ID NO: 82579 - DNA, 15 bp, Homo sapiens
gagcagctgcagaga

SEQ ID NO: 82580 - DNA, 15 bp, Homo sapiens
agcagctgcagagag

SEQ ID NO: 82581 - DNA, 15 bp, Homo sapiens
gcagctgcagagagg

SEQ ID NO: 82582 - DNA, 15 bp, Homo sapiens
cagctgcagagaggc

SEQ ID NO: 82583 - DNA, 15 bp, Homo sapiens
agctgcagagaggcc

SEQ ID NO: 82584 - DNA, 15 bp, Homo sapiens
gctgcagagaggccc

SEQ ID NO: 82585 - DNA, 15 bp, Homo sapiens
ctgcagagaggcccc

SEQ ID NO: 82586 - DNA, 15 bp, Homo sapiens
tgcagagaggcccca

SEQ ID NO: 82587 - DNA, 15 bp, Homo sapiens
gcagagaggccccaa

SEQ ID NO: 82588 - DNA, 15 bp, Homo sapiens
cagagaggccccaac

SEQ ID NO: 82589 - DNA, 15 bp, Homo sapiens
agagaggccccaacc

SEQ ID NO: 82590 - DNA, 15 bp, Homo sapiens
gagaggccccaacca

SEQ ID NO: 82591 - DNA, 15 bp, Homo sapiens
agaggccccaaccag

SEQ ID NO: 82592 - DNA, 15 bp, Homo sapiens
gaggccccaaccagc

SEQ ID NO: 82593 - DNA, 15 bp, Homo sapiens
aggccccaaccagcc

SEQ ID NO: 82594 - DNA, 15 bp, Homo sapiens
ggccccaaccagccc

SEQ ID NO: 82595 - DNA, 15 bp, Homo sapiens
gccccaaccagcccg

SEQ ID NO: 82596 - DNA, 15 bp, Homo sapiens
ccccaaccagcccgt

SEQ ID NO: 82597 - DNA, 15 bp, Homo sapiens
cccaaccagcccgtg

SEQ ID NO: 82598 - DNA, 15 bp, Homo sapiens
ccaaccagcccgtgg

SEQ ID NO: 82599 - DNA, 15 bp, Homo sapiens
caaccagcccgtgga

SEQ ID NO: 82600 - DNA, 15 bp, Homo sapiens
aaccagcccgtggag

SEQ ID NO: 82601 - DNA, 15 bp, Homo sapiens
accagcccgtggaga

SEQ ID NO: 82602 - DNA, 15 bp, Homo sapiens
ccagcccgtggagag

SEQ ID NO: 82603 - DNA, 15 bp, Homo sapiens
cagcccgtggagagt

SEQ ID NO: 82604 - DNA, 15 bp, Homo sapiens
agcccgtggagagtg

SEQ ID NO: 82605 - DNA, 15 bp, Homo sapiens
gcccgtggagagtga

SEQ ID NO: 82606 - DNA, 15 bp, Homo sapiens
cccgtggagagtgac

SEQ ID NO: 82607 - DNA, 15 bp, Homo sapiens
ccgtggagagtgacg

SEQ ID NO: 82608 - DNA, 15 bp, Homo sapiens
cgtggagagtgacga

SEQ ID NO: 82609 - DNA, 15 bp, Homo sapiens
gtggagagtgacgag

SEQ ID NO: 82610 - DNA, 15 bp, Homo sapiens
tggagagtgacgaga

SEQ ID NO: 82611 - DNA, 15 bp, Homo sapiens
ggagagtgacgagag

SEQ ID NO: 82612 - DNA, 15 bp, Homo sapiens
gagagtgacgagagc

SEQ ID NO: 82613 - DNA, 15 bp, Homo sapiens
agagtgacgagagcc

SEQ ID NO: 82614 - DNA, 15 bp, Homo sapiens
gagtgacgagagcct

SEQ ID NO: 82615 - DNA, 15 bp, Homo sapiens
agtgacgagagccta

SEQ ID NO: 82616 - DNA, 15 bp, Homo sapiens
gtgacgagagcctag

SEQ ID NO: 82617 - DNA, 15 bp, Homo sapiens
tgacgagagcctagg

SEQ ID NO: 82618 - DNA, 15 bp, Homo sapiens
gacgagagcctaggc

SEQ ID NO: 82619 - DNA, 15 bp, Homo sapiens
acgagagcctaggcg

SEQ ID NO: 82620 - DNA, 15 bp, Homo sapiens
cgagagcctaggcgg

SEQ ID NO: 82621 - DNA, 15 bp, Homo sapiens
gagagcctaggcggc

SEQ ID NO: 82622 - DNA, 15 bp, Homo sapiens
agagcctaggcggcc

SEQ ID NO: 82623 - DNA, 15 bp, Homo sapiens
gagcctaggcggcct

SEQ ID NO: 82624 - DNA, 15 bp, Homo sapiens
agcctaggcggcctc

SEQ ID NO: 82625 - DNA, 15 bp, Homo sapiens
gcctaggcggcctct

SEQ ID NO: 82626 - DNA, 15 bp, Homo sapiens
cctaggcggcctctc

SEQ ID NO: 82627 - DNA, 15 bp, Homo sapiens
ctaggcggcctctct

SEQ ID NO: 82628 - DNA, 15 bp, Homo sapiens
taggcggcctctctg

SEQ ID NO: 82629 - DNA, 15 bp, Homo sapiens
aggcggcctctctgc

SEQ ID NO: 82630 - DNA, 15 bp, Homo sapiens
ggcggcctctctgct

SEQ ID NO: 82631 - DNA, 15 bp, Homo sapiens
gcggcctctctgctg

SEQ ID NO: 82632 - DNA, 15 bp, Homo sapiens
cggcctctctgctgc

SEQ ID NO: 82633 - DNA, 15 bp, Homo sapiens
ggcctctctgctgcc

SEQ ID NO: 82634 - DNA, 15 bp, Homo sapiens
gcctctctgctgccc

SEQ ID NO: 82635 - DNA, 15 bp, Homo sapiens
cctctctgctgccct

SEQ ID NO: 82636 - DNA, 15 bp, Homo sapiens
ctctctgctgccctg

SEQ ID NO: 82637 - DNA, 15 bp, Homo sapiens
tctctgctgccctgc

SEQ ID NO: 82638 - DNA, 15 bp, Homo sapiens
ctctgctgccctgcg

SEQ ID NO: 82639 - DNA, 15 bp, Homo sapiens
tctgctgccctgcgc

SEQ ID NO: 82640 - DNA, 15 bp, Homo sapiens
ctgctgccctgcgct

SEQ ID NO: 82641 - DNA, 15 bp, Homo sapiens
tgctgccctgcgctc

SEQ ID NO: 82642 - DNA, 15 bp, Homo sapiens
gctgccctgcgctcc

SEQ ID NO: 82643 - DNA, 15 bp, Homo sapiens
ctgccctgcgctcct

SEQ ID NO: 82644 - DNA, 15 bp, Homo sapiens
tgccctgcgctcctg

SEQ ID NO: 82645 - DNA, 15 bp, Homo sapiens
gccctgcgctcctgg

SEQ ID NO: 82646 - DNA, 15 bp, Homo sapiens
ccctgcgctcctggc

SEQ ID NO: 82647 - DNA, 15 bp, Homo sapiens
cctgcgctcctggca

SEQ ID NO: 82648 - DNA, 15 bp, Homo sapiens
ctgcgctcctggcac

SEQ ID NO: 82649 - DNA, 15 bp, Homo sapiens
tgcgctcctggcact

SEQ ID NO: 82650 - DNA, 15 bp, Homo sapiens
gcgctcctggcactt

SEQ ID NO: 82651 - DNA, 15 bp, Homo sapiens
cgctcctggcacttg

SEQ ID NO: 82652 - DNA, 15 bp, Homo sapiens
gctcctggcacttga

SEQ ID NO: 82653 - DNA, 15 bp, Homo sapiens
ctcctggcacttgac

SEQ ID NO: 82654 - DNA, 15 bp, Homo sapiens
tcctggcacttgact

SEQ ID NO: 82655 - DNA, 15 bp, Homo sapiens
cctggcacttgactc

SEQ ID NO: 82656 - DNA, 15 bp, Homo sapiens
ctggcacttgactcc

SEQ ID NO: 82657 - DNA, 15 bp, Homo sapiens
tggcacttgactcca

SEQ ID NO: 82658 - DNA, 15 bp, Homo sapiens
ggcacttgactccaa

SEQ ID NO: 82659 - DNA, 15 bp, Homo sapiens
gcacttgactccaag

SEQ ID NO: 82660 - DNA, 15 bp, Homo sapiens
cacttgactccaagc

SEQ ID NO: 82661 - DNA, 15 bp, Homo sapiens
acttgactccaagct

SEQ ID NO: 82662 - DNA, 15 bp, Homo sapiens
cttgactccaagctg

SEQ ID NO: 82663 - DNA, 15 bp, Homo sapiens
ttgactccaagctgc

SEQ ID NO: 82664 - DNA, 15 bp, Homo sapiens
tgactccaagctgcc

SEQ ID NO: 82665 - DNA, 15 bp, Homo sapiens
gactccaagctgccc

SEQ ID NO: 82666 - DNA, 15 bp, Homo sapiens
actccaagctgccct

SEQ ID NO: 82667 - DNA, 15 bp, Homo sapiens
ctccaagctgccctc

SEQ ID NO: 82668 - DNA, 15 bp, Homo sapiens
tccaagctgccctct

SEQ ID NO: 82669 - DNA, 15 bp, Homo sapiens
ccaagctgccctctg

SEQ ID NO: 82670 - DNA, 15 bp, Homo sapiens
caagctgccctctgg

SEQ ID NO: 82671 - DNA, 15 bp, Homo sapiens
aagctgccctctgga

SEQ ID NO: 82672 - DNA, 15 bp, Homo sapiens
agctgccctctggac

SEQ ID NO: 82673 - DNA, 15 bp, Homo sapiens
gctgccctctggacc

SEQ ID NO: 82674 - DNA, 15 bp, Homo sapiens
ctgccctctggaccc

SEQ ID NO: 82675 - DNA, 15 bp, Homo sapiens
tgccctctggaccca

SEQ ID NO: 82676 - DNA, 15 bp, Homo sapiens
gccctctggacccag

SEQ ID NO: 82677 - DNA, 15 bp, Homo sapiens
ccctctggacccagc

SEQ ID NO: 82678 - DNA, 15 bp, Homo sapiens
cctctggacccagca

SEQ ID NO: 82679 - DNA, 15 bp, Homo sapiens
ctctggacccagcac

SEQ ID NO: 82680 - DNA, 15 bp, Homo sapiens
tctggacccagcacc

SEQ ID NO: 82681 - DNA, 15 bp, Homo sapiens
ctggacccagcaccc

SEQ ID NO: 82682 - DNA, 15 bp, Homo sapiens
tggacccagcacccc

SEQ ID NO: 82683 - DNA, 15 bp, Homo sapiens
ggacccagcacccct

SEQ ID NO: 82684 - DNA, 15 bp, Homo sapiens
gacccagcacccctc

SEQ ID NO: 82685 - DNA, 15 bp, Homo sapiens
acccagcacccctca

SEQ ID NO: 82686 - DNA, 15 bp, Homo sapiens
cccagcacccctcag

SEQ ID NO: 82687 - DNA, 15 bp, Homo sapiens
ccagcacccctcagg

SEQ ID NO: 82688 - DNA, 15 bp, Homo sapiens
cagcacccctcaggg

SEQ ID NO: 82689 - DNA, 15 bp, Homo sapiens
agcacccctcaggga

SEQ ID NO: 82690 - DNA, 15 bp, Homo sapiens
gcacccctcagggag

SEQ ID NO: 82691 - DNA, 15 bp, Homo sapiens
cacccctcagggagg

SEQ ID NO: 82692 - DNA, 15 bp, Homo sapiens
acccctcagggaggc

SEQ ID NO: 82693 - DNA, 15 bp, Homo sapiens
cccctcagggaggcc

SEQ ID NO: 82694 - DNA, 15 bp, Homo sapiens
ccctcagggaggccg

SEQ ID NO: 82695 - DNA, 15 bp, Homo sapiens
cctcagggaggccgg

SEQ ID NO: 82696 - DNA, 15 bp, Homo sapiens
ctcagggaggccggc

SEQ ID NO: 82697 - DNA, 15 bp, Homo sapiens
tcagggaggccggct

SEQ ID NO: 82698 - DNA, 15 bp, Homo sapiens
cagggaggccggctg

SEQ ID NO: 82699 - DNA, 15 bp, Homo sapiens
agggaggccggctgt

SEQ ID NO: 82700 - DNA, 15 bp, Homo sapiens
gggaggccggctgtc

SEQ ID NO: 82701 - DNA, 15 bp, Homo sapiens
ggaggccggctgtcc

SEQ ID NO: 82702 - DNA, 15 bp, Homo sapiens
gaggccggctgtcct

SEQ ID NO: 82703 - DNA, 15 bp, Homo sapiens
aggccggctgtcctc

SEQ ID NO: 82704 - DNA, 15 bp, Homo sapiens
ggccggctgtcctca

SEQ ID NO: 82705 - DNA, 15 bp, Homo sapiens
gccggctgtcctcag

SEQ ID NO: 82706 - DNA, 15 bp, Homo sapiens
ccggctgtcctcagg

SEQ ID NO: 82707 - DNA, 15 bp, Homo sapiens
cggctgtcctcaggg

SEQ ID NO: 82708 - DNA, 15 bp, Homo sapiens
ggctgtcctcagggg

SEQ ID NO: 82709 - DNA, 15 bp, Homo sapiens
gctgtcctcaggggg

SEQ ID NO: 82710 - DNA, 15 bp, Homo sapiens
ctgtcctcaggggga

SEQ ID NO: 82711 - DNA, 15 bp, Homo sapiens
tgtcctcagggggac

SEQ ID NO: 82712 - DNA, 15 bp, Homo sapiens
gtcctcagggggaca

SEQ ID NO: 82713 - DNA, 15 bp, Homo sapiens
tcctcagggggacac

SEQ ID NO: 82714 - DNA, 15 bp, Homo sapiens
cctcagggggacacg

SEQ ID NO: 82715 - DNA, 15 bp, Homo sapiens
ctcagggggacacgg

SEQ ID NO: 82716 - DNA, 15 bp, Homo sapiens
tcagggggacacggc

SEQ ID NO: 82717 - DNA, 15 bp, Homo sapiens
cagggggacacggca

SEQ ID NO: 82718 - DNA, 15 bp, Homo sapiens
agggggacacggcag

SEQ ID NO: 82719 - DNA, 15 bp, Homo sapiens
gggggacacggcagg

SEQ ID NO: 82720 - DNA, 15 bp, Homo sapiens
ggggacacggcagga

SEQ ID NO: 82721 - DNA, 15 bp, Homo sapiens
gggacacggcaggag

SEQ ID NO: 82722 - DNA, 15 bp, Homo sapiens
ggacacggcaggaga

SEQ ID NO: 82723 - DNA, 15 bp, Homo sapiens
gacacggcaggagaa

SEQ ID NO: 82724 - DNA, 15 bp, Homo sapiens
acacggcaggagaat

SEQ ID NO: 82725 - DNA, 15 bp, Homo sapiens
cacggcaggagaatc

SEQ ID NO: 82726 - DNA, 15 bp, Homo sapiens
acggcaggagaatcg

SEQ ID NO: 82727 - DNA, 15 bp, Homo sapiens
cggcaggagaatcga

SEQ ID NO: 82728 - DNA, 15 bp, Homo sapiens
ggcaggagaatcgag

SEQ ID NO: 82729 - DNA, 15 bp, Homo sapiens
gcaggagaatcgagc

SEQ ID NO: 82730 - DNA, 15 bp, Homo sapiens
caggagaatcgagct

SEQ ID NO: 82731 - DNA, 15 bp, Homo sapiens
aggagaatcgagctg

SEQ ID NO: 82732 - DNA, 15 bp, Homo sapiens
ggagaatcgagctgg

SEQ ID NO: 82733 - DNA, 15 bp, Homo sapiens
gagaatcgagctggg

SEQ ID NO: 82734 - DNA, 15 bp, Homo sapiens
agaatcgagctgggg

SEQ ID NO: 82735 - DNA, 15 bp, Homo sapiens
gaatcgagctggggg

SEQ ID NO: 82736 - DNA, 15 bp, Homo sapiens
aatcgagctggggga

SEQ ID NO: 82737 - DNA, 15 bp, Homo sapiens
atcgagctgggggag

SEQ ID NO: 82738 - DNA, 15 bp, Homo sapiens
tcgagctgggggagt

SEQ ID NO: 82739 - DNA, 15 bp, Homo sapiens
cgagctgggggagtg

SEQ ID NO: 82740 - DNA, 15 bp, Homo sapiens
gagctgggggagtgg

SEQ ID NO: 82741 - DNA, 15 bp, Homo sapiens
agctgggggagtggc

SEQ ID NO: 82742 - DNA, 15 bp, Homo sapiens
gctgggggagtggcc

SEQ ID NO: 82743 - DNA, 15 bp, Homo sapiens
ctgggggagtggccc

SEQ ID NO: 82744 - DNA, 15 bp, Homo sapiens
tgggggagtggccca

SEQ ID NO: 82745 - DNA, 15 bp, Homo sapiens
gggggagtggcccag

SEQ ID NO: 82746 - DNA, 15 bp, Homo sapiens
ggggagtggcccagg

SEQ ID NO: 82747 - DNA, 15 bp, Homo sapiens
gggagtggcccagga

SEQ ID NO: 82748 - DNA, 15 bp, Homo sapiens
ggagtggcccaggat

SEQ ID NO: 82749 - DNA, 15 bp, Homo sapiens
gagtggcccaggatc

SEQ ID NO: 82750 - DNA, 15 bp, Homo sapiens
agtggcccaggatcc

SEQ ID NO: 82751 - DNA, 15 bp, Homo sapiens
gtggcccaggatccc

SEQ ID NO: 82752 - DNA, 15 bp, Homo sapiens
tggcccaggatcccg

SEQ ID NO: 82753 - DNA, 15 bp, Homo sapiens
ggcccaggatcccgg

SEQ ID NO: 82754 - DNA, 15 bp, Homo sapiens
gcccaggatcccggc

SEQ ID NO: 82755 - DNA, 15 bp, Homo sapiens
cccaggatcccggcc

SEQ ID NO: 82756 - DNA, 15 bp, Homo sapiens
ccaggatcccggccc

SEQ ID NO: 82757 - DNA, 15 bp, Homo sapiens
caggatcccggccca

SEQ ID NO: 82758 - DNA, 15 bp, Homo sapiens
aggatcccggcccac

SEQ ID NO: 82759 - DNA, 15 bp, Homo sapiens
ggatcccggcccaca

SEQ ID NO: 82760 - DNA, 15 bp, Homo sapiens
gatcccggcccacag

SEQ ID NO: 82761 - DNA, 15 bp, Homo sapiens
atcccggcccacagc

SEQ ID NO: 82762 - DNA, 15 bp, Homo sapiens
tcccggcccacagcc

SEQ ID NO: 82763 - DNA, 15 bp, Homo sapiens
cccggcccacagccg

SEQ ID NO: 82764 - DNA, 15 bp, Homo sapiens
ccggcccacagccgt

SEQ ID NO: 82765 - DNA, 15 bp, Homo sapiens
cggcccacagccgtg

SEQ ID NO: 82766 - DNA, 15 bp, Homo sapiens
ggcccacagccgtgg

SEQ ID NO: 82767 - DNA, 15 bp, Homo sapiens
gcccacagccgtgga

SEQ ID NO: 82768 - DNA, 15 bp, Homo sapiens
cccacagccgtggaa

SEQ ID NO: 82769 - DNA, 15 bp, Homo sapiens
ccacagccgtggaag

SEQ ID NO: 82770 - DNA, 15 bp, Homo sapiens
cacagccgtggaagg

SEQ ID NO: 82771 - DNA, 15 bp, Homo sapiens
acagccgtggaaggt

SEQ ID NO: 82772 - DNA, 15 bp, Homo sapiens
cagccgtggaaggta

SEQ ID NO: 82773 - DNA, 15 bp, Homo sapiens
agccgtggaaggtag

SEQ ID NO: 82774 - DNA, 15 bp, Homo sapiens
gccgtggaaggtagc

SEQ ID NO: 82775 - DNA, 15 bp, Homo sapiens
ccgtggaaggtagct

SEQ ID NO: 82776 - DNA, 15 bp, Homo sapiens
cgtggaaggtagctg

SEQ ID NO: 82777 - DNA, 15 bp, Homo sapiens
gtggaaggtagctgg

SEQ ID NO: 82778 - DNA, 15 bp, Homo sapiens
tggaaggtagctggg

SEQ ID NO: 82779 - DNA, 15 bp, Homo sapiens
ggaaggtagctgggg

SEQ ID NO: 82780 - DNA, 15 bp, Homo sapiens
gaaggtagctgggga

SEQ ID NO: 82781 - DNA, 15 bp, Homo sapiens
aaggtagctggggag

SEQ ID NO: 82782 - DNA, 15 bp, Homo sapiens
aggtagctggggaga

SEQ ID NO: 82783 - DNA, 15 bp, Homo sapiens
ggtagctggggagac

SEQ ID NO: 82784 - DNA, 15 bp, Homo sapiens
gtagctggggagacg

SEQ ID NO: 82785 - DNA, 15 bp, Homo sapiens
tagctggggagacgg

SEQ ID NO: 82786 - DNA, 15 bp, Homo sapiens
agctggggagacggg

SEQ ID NO: 82787 - DNA, 15 bp, Homo sapiens
gctggggagacgggt

SEQ ID NO: 82788 - DNA, 15 bp, Homo sapiens
ctggggagacgggtt

SEQ ID NO: 82789 - DNA, 15 bp, Homo sapiens
tggggagacgggttc

SEQ ID NO: 82790 - DNA, 15 bp, Homo sapiens
ggggagacgggttcc

SEQ ID NO: 82791 - DNA, 15 bp, Homo sapiens
gggagacgggttccc

SEQ ID NO: 82792 - DNA, 15 bp, Homo sapiens
ggagacgggttccca

SEQ ID NO: 82793 - DNA, 15 bp, Homo sapiens
gagacgggttcccag

SEQ ID NO: 82794 - DNA, 15 bp, Homo sapiens
agacgggttcccagg

SEQ ID NO: 82795 - DNA, 15 bp, Homo sapiens
gacgggttcccagga

SEQ ID NO: 82796 - DNA, 15 bp, Homo sapiens
acgggttcccaggag

SEQ ID NO: 82797 - DNA, 15 bp, Homo sapiens
cgggttcccaggaga

SEQ ID NO: 82798 - DNA, 15 bp, Homo sapiens
gggttcccaggagag

SEQ ID NO: 82799 - DNA, 15 bp, Homo sapiens
ggttcccaggagagg

SEQ ID NO: 82800 - DNA, 15 bp, Homo sapiens
gttcccaggagaggg

SEQ ID NO: 82801 - DNA, 15 bp, Homo sapiens
ttcccaggagaggga

SEQ ID NO: 82802 - DNA, 15 bp, Homo sapiens
tcccaggagagggac

SEQ ID NO: 82803 - DNA, 15 bp, Homo sapiens
cccaggagagggacc

SEQ ID NO: 82804 - DNA, 15 bp, Homo sapiens
ccaggagagggacca

SEQ ID NO: 82805 - DNA, 15 bp, Homo sapiens
caggagagggaccaa

SEQ ID NO: 82806 - DNA, 15 bp, Homo sapiens
aggagagggaccaag

SEQ ID NO: 82807 - DNA, 15 bp, Homo sapiens
ggagagggaccaagg

SEQ ID NO: 82808 - DNA, 15 bp, Homo sapiens
gagagggaccaaggc

SEQ ID NO: 82809 - DNA, 15 bp, Homo sapiens
agagggaccaaggcc

SEQ ID NO: 82810 - DNA, 15 bp, Homo sapiens
gagggaccaaggcct

SEQ ID NO: 82811 - DNA, 15 bp, Homo sapiens
agggaccaaggcctc

SEQ ID NO: 82812 - DNA, 15 bp, Homo sapiens
gggaccaaggcctct

SEQ ID NO: 82813 - DNA, 15 bp, Homo sapiens
ggaccaaggcctctt

SEQ ID NO: 82814 - DNA, 15 bp, Homo sapiens
gaccaaggcctcttt

SEQ ID NO: 82815 - DNA, 15 bp, Homo sapiens
accaaggcctctttg

SEQ ID NO: 82816 - DNA, 15 bp, Homo sapiens
ccaaggcctctttgg

SEQ ID NO: 82817 - DNA, 15 bp, Homo sapiens
caaggcctctttggg

SEQ ID NO: 82818 - DNA, 15 bp, Homo sapiens
aaggcctctttgggc

SEQ ID NO: 82819 - DNA, 15 bp, Homo sapiens
aggcctctttgggcc

SEQ ID NO: 82820 - DNA, 15 bp, Homo sapiens
ggcctctttgggcca

SEQ ID NO: 82821 - DNA, 15 bp, Homo sapiens
gcctctttgggccaa

SEQ ID NO: 82822 - DNA, 15 bp, Homo sapiens
cctctttgggccaaa

SEQ ID NO: 82823 - DNA, 15 bp, Homo sapiens
ctctttgggccaaag

SEQ ID NO: 82824 - DNA, 15 bp, Homo sapiens
tctttgggccaaagc

SEQ ID NO: 82825 - DNA, 15 bp, Homo sapiens
ctttgggccaaagcc

SEQ ID NO: 82826 - DNA, 15 bp, Homo sapiens
tttgggccaaagccc

SEQ ID NO: 82827 - DNA, 15 bp, Homo sapiens
ttgggccaaagcccc

SEQ ID NO: 82828 - DNA, 15 bp, Homo sapiens
tgggccaaagcccct

SEQ ID NO: 82829 - DNA, 15 bp, Homo sapiens
gggccaaagcccctg

SEQ ID NO: 82830 - DNA, 15 bp, Homo sapiens
ggccaaagcccctgt

SEQ ID NO: 82831 - DNA, 15 bp, Homo sapiens
gccaaagcccctgta

SEQ ID NO: 82832 - DNA, 15 bp, Homo sapiens
ccaaagcccctgtaa

SEQ ID NO: 82833 - DNA, 15 bp, Homo sapiens
caaagcccctgtaag

SEQ ID NO: 82834 - DNA, 15 bp, Homo sapiens
aaagcccctgtaagt

SEQ ID NO: 82835 - DNA, 15 bp, Homo sapiens
aagcccctgtaagtc

SEQ ID NO: 82836 - DNA, 15 bp, Homo sapiens
agcccctgtaagtcc

SEQ ID NO: 82837 - DNA, 15 bp, Homo sapiens
gcccctgtaagtccc

SEQ ID NO: 82838 - DNA, 15 bp, Homo sapiens
cccctgtaagtcccc

SEQ ID NO: 82839 - DNA, 15 bp, Homo sapiens
ccctgtaagtcccca

SEQ ID NO: 82840 - DNA, 15 bp, Homo sapiens
cctgtaagtccccac

SEQ ID NO: 82841 - DNA, 15 bp, Homo sapiens
ctgtaagtccccacc

SEQ ID NO: 82842 - DNA, 15 bp, Homo sapiens
tgtaagtccccaccc

SEQ ID NO: 82843 - DNA, 15 bp, Homo sapiens
gtaagtccccacccc

SEQ ID NO: 82844 - DNA, 15 bp, Homo sapiens
taagtccccacccca

SEQ ID NO: 82845 - DNA, 15 bp, Homo sapiens
aagtccccaccccag

SEQ ID NO: 82846 - DNA, 15 bp, Homo sapiens
agtccccaccccagc

SEQ ID NO: 82847 - DNA, 15 bp, Homo sapiens
gtccccaccccagcc

SEQ ID NO: 82848 - DNA, 15 bp, Homo sapiens
tccccaccccagcct

SEQ ID NO: 82849 - DNA, 15 bp, Homo sapiens
ccccaccccagcctt

SEQ ID NO: 82850 - DNA, 15 bp, Homo sapiens
cccaccccagccttc

SEQ ID NO: 82851 - DNA, 15 bp, Homo sapiens
ccaccccagccttct

SEQ ID NO: 82852 - DNA, 15 bp, Homo sapiens
caccccagccttcta

SEQ ID NO: 82853 - DNA, 15 bp, Homo sapiens
accccagccttctag

SEQ ID NO: 82854 - DNA, 15 bp, Homo sapiens
ccccagccttctaga

SEQ ID NO: 82855 - DNA, 15 bp, Homo sapiens
cccagccttctagaa

SEQ ID NO: 82856 - DNA, 15 bp, Homo sapiens
ccagccttctagaag

SEQ ID NO: 82857 - DNA, 15 bp, Homo sapiens
cagccttctagaaga

SEQ ID NO: 82858 - DNA, 15 bp, Homo sapiens
agccttctagaagag

SEQ ID NO: 82859 - DNA, 15 bp, Homo sapiens
gccttctagaagaga

SEQ ID NO: 82860 - DNA, 15 bp, Homo sapiens
ccttctagaagagaa

SEQ ID NO: 82861 - DNA, 15 bp, Homo sapiens
cttctagaagagaac

SEQ ID NO: 82862 - DNA, 15 bp, Homo sapiens
ttctagaagagaacc

SEQ ID NO: 82863 - DNA, 15 bp, Homo sapiens
tctagaagagaacca

SEQ ID NO: 82864 - DNA, 15 bp, Homo sapiens
ctagaagagaaccag

SEQ ID NO: 82865 - DNA, 15 bp, Homo sapiens
tagaagagaaccagg

SEQ ID NO: 82866 - DNA, 15 bp, Homo sapiens
agaagagaaccaggg

SEQ ID NO: 82867 - DNA, 15 bp, Homo sapiens
gaagagaaccagggc

SEQ ID NO: 82868 - DNA, 15 bp, Homo sapiens
aagagaaccagggcc

SEQ ID NO: 82869 - DNA, 15 bp, Homo sapiens
agagaaccagggcca

SEQ ID NO: 82870 - DNA, 15 bp, Homo sapiens
gagaaccagggccaa

SEQ ID NO: 82871 - DNA, 15 bp, Homo sapiens
agaaccagggccaaa

SEQ ID NO: 82872 - DNA, 15 bp, Homo sapiens
gaaccagggccaaat

SEQ ID NO: 82873 - DNA, 15 bp, Homo sapiens
aaccagggccaaatg

SEQ ID NO: 82874 - DNA, 15 bp, Homo sapiens
accagggccaaatgt

SEQ ID NO: 82875 - DNA, 15 bp, Homo sapiens
ccagggccaaatgtt

SEQ ID NO: 82876 - DNA, 15 bp, Homo sapiens
cagggccaaatgttc

SEQ ID NO: 82877 - DNA, 15 bp, Homo sapiens
agggccaaatgttca

SEQ ID NO: 82878 - DNA, 15 bp, Homo sapiens
gggccaaatgttcag

SEQ ID NO: 82879 - DNA, 15 bp, Homo sapiens
ggccaaatgttcagc

SEQ ID NO: 82880 - DNA, 15 bp, Homo sapiens
gccaaatgttcagct

SEQ ID NO: 82881 - DNA, 15 bp, Homo sapiens
ccaaatgttcagctc

SEQ ID NO: 82882 - DNA, 15 bp, Homo sapiens
caaatgttcagctca

SEQ ID NO: 82883 - DNA, 15 bp, Homo sapiens
aaatgttcagctcac

SEQ ID NO: 82884 - DNA, 15 bp, Homo sapiens
aatgttcagctcact

SEQ ID NO: 82885 - DNA, 15 bp, Homo sapiens
atgttcagctcactg

SEQ ID NO: 82886 - DNA, 15 bp, Homo sapiens
tgttcagctcactgt

SEQ ID NO: 82887 - DNA, 15 bp, Homo sapiens
gttcagctcactgtg

SEQ ID NO: 82888 - DNA, 15 bp, Homo sapiens
ttcagctcactgtga

SEQ ID NO: 82889 - DNA, 15 bp, Homo sapiens
tcagctcactgtgac

SEQ ID NO: 82890 - DNA, 15 bp, Homo sapiens
cagctcactgtgacc

SEQ ID NO: 82891 - DNA, 15 bp, Homo sapiens
agctcactgtgacct

SEQ ID NO: 82892 - DNA, 15 bp, Homo sapiens
gctcactgtgacctt

SEQ ID NO: 82893 - DNA, 15 bp, Homo sapiens
ctcactgtgacctta

SEQ ID NO: 82894 - DNA, 15 bp, Homo sapiens
tcactgtgaccttag

SEQ ID NO: 82895 - DNA, 15 bp, Homo sapiens
cactgtgaccttagc

SEQ ID NO: 82896 - DNA, 15 bp, Homo sapiens
actgtgaccttagca

SEQ ID NO: 82897 - DNA, 15 bp, Homo sapiens
ctgtgaccttagcaa

SEQ ID NO: 82898 - DNA, 15 bp, Homo sapiens
tgtgaccttagcaac

SEQ ID NO: 82899 - DNA, 15 bp, Homo sapiens
gtgaccttagcaacc

SEQ ID NO: 82900 - DNA, 15 bp, Homo sapiens
tgaccttagcaaccc

SEQ ID NO: 82901 - DNA, 15 bp, Homo sapiens
gaccttagcaaccct

SEQ ID NO: 82902 - DNA, 15 bp, Homo sapiens
accttagcaaccctg

SEQ ID NO: 82903 - DNA, 15 bp, Homo sapiens
ccttagcaaccctgg

SEQ ID NO: 82904 - DNA, 15 bp, Homo sapiens
cttagcaaccctggt

SEQ ID NO: 82905 - DNA, 15 bp, Homo sapiens
ttagcaaccctggtt

SEQ ID NO: 82906 - DNA, 15 bp, Homo sapiens
tagcaaccctggttt

SEQ ID NO: 82907 - DNA, 15 bp, Homo sapiens
agcaaccctggtttc

SEQ ID NO: 82908 - DNA, 15 bp, Homo sapiens
gcaaccctggtttcc

SEQ ID NO: 82909 - DNA, 15 bp, Homo sapiens
caaccctggtttccc

SEQ ID NO: 82910 - DNA, 15 bp, Homo sapiens
aaccctggtttcccc

SEQ ID NO: 82911 - DNA, 15 bp, Homo sapiens
accctggtttcccct

SEQ ID NO: 82912 - DNA, 15 bp, Homo sapiens
ccctggtttcccctc

SEQ ID NO: 82913 - DNA, 15 bp, Homo sapiens
cctggtttcccctcc

SEQ ID NO: 82914 - DNA, 15 bp, Homo sapiens
ctggtttcccctccc

SEQ ID NO: 82915 - DNA, 15 bp, Homo sapiens
tggtttcccctcccc

SEQ ID NO: 82916 - DNA, 15 bp, Homo sapiens
ggtttcccctcccca

SEQ ID NO: 82917 - DNA, 15 bp, Homo sapiens
gtttcccctccccag

SEQ ID NO: 82918 - DNA, 15 bp, Homo sapiens
tttcccctccccagg

SEQ ID NO: 82919 - DNA, 15 bp, Homo sapiens
ttcccctccccaggc

SEQ ID NO: 82920 - DNA, 15 bp, Homo sapiens
tcccctccccaggcc

SEQ ID NO: 82921 - DNA, 15 bp, Homo sapiens
cccctccccaggcca

SEQ ID NO: 82922 - DNA, 15 bp, Homo sapiens
ccctccccaggccac

SEQ ID NO: 82923 - DNA, 15 bp, Homo sapiens
cctccccaggccaca

SEQ ID NO: 82924 - DNA, 15 bp, Homo sapiens
ctccccaggccacat

SEQ ID NO: 82925 - DNA, 15 bp, Homo sapiens
tccccaggccacatc

SEQ ID NO: 82926 - DNA, 15 bp, Homo sapiens
ccccaggccacatcc

SEQ ID NO: 82927 - DNA, 15 bp, Homo sapiens
cccaggccacatcct

SEQ ID NO: 82928 - DNA, 15 bp, Homo sapiens
ccaggccacatcctt

SEQ ID NO: 82929 - DNA, 15 bp, Homo sapiens
caggccacatccttc

SEQ ID NO: 82930 - DNA, 15 bp, Homo sapiens
aggccacatccttcc

SEQ ID NO: 82931 - DNA, 15 bp, Homo sapiens
ggccacatccttccc

SEQ ID NO: 82932 - DNA, 15 bp, Homo sapiens
gccacatccttccca

SEQ ID NO: 82933 - DNA, 15 bp, Homo sapiens
ccacatccttcccag

SEQ ID NO: 82934 - DNA, 15 bp, Homo sapiens
cacatccttcccagg

SEQ ID NO: 82935 - DNA, 15 bp, Homo sapiens
acatccttcccaggt

SEQ ID NO: 82936 - DNA, 15 bp, Homo sapiens
catccttcccaggtg

SEQ ID NO: 82937 - DNA, 15 bp, Homo sapiens
atccttcccaggtgg

SEQ ID NO: 82938 - DNA, 15 bp, Homo sapiens
tccttcccaggtgga

SEQ ID NO: 82939 - DNA, 15 bp, Homo sapiens
ccttcccaggtggag

SEQ ID NO: 82940 - DNA, 15 bp, Homo sapiens
cttcccaggtggagc

SEQ ID NO: 82941 - DNA, 15 bp, Homo sapiens
ttcccaggtggagct

SEQ ID NO: 82942 - DNA, 15 bp, Homo sapiens
tcccaggtggagctt

SEQ ID NO: 82943 - DNA, 15 bp, Homo sapiens
cccaggtggagcttg

SEQ ID NO: 82944 - DNA, 15 bp, Homo sapiens
ccaggtggagcttgc

SEQ ID NO: 82945 - DNA, 15 bp, Homo sapiens
caggtggagcttgct

SEQ ID NO: 82946 - DNA, 15 bp, Homo sapiens
aggtggagcttgctc

SEQ ID NO: 82947 - DNA, 15 bp, Homo sapiens
ggtggagcttgctct

SEQ ID NO: 82948 - DNA, 15 bp, Homo sapiens
gtggagcttgctctc

SEQ ID NO: 82949 - DNA, 15 bp, Homo sapiens
tggagcttgctctcc

SEQ ID NO: 82950 - DNA, 15 bp, Homo sapiens
ggagcttgctctcca

SEQ ID NO: 82951 - DNA, 15 bp, Homo sapiens
gagcttgctctccag

SEQ ID NO: 82952 - DNA, 15 bp, Homo sapiens
agcttgctctccagc

SEQ ID NO: 82953 - DNA, 15 bp, Homo sapiens
gcttgctctccagcc

SEQ ID NO: 82954 - DNA, 15 bp, Homo sapiens
cttgctctccagccc

SEQ ID NO: 82955 - DNA, 15 bp, Homo sapiens
ttgctctccagccct

SEQ ID NO: 82956 - DNA, 15 bp, Homo sapiens
tgctctccagccctc

SEQ ID NO: 82957 - DNA, 15 bp, Homo sapiens
gctctccagccctcc

SEQ ID NO: 82958 - DNA, 15 bp, Homo sapiens
ctctccagccctccc

SEQ ID NO: 82959 - DNA, 15 bp, Homo sapiens
tctccagccctcccc

SEQ ID NO: 82960 - DNA, 15 bp, Homo sapiens
ctccagccctccccc

SEQ ID NO: 82961 - DNA, 15 bp, Homo sapiens
tccagccctcccccc

SEQ ID NO: 82962 - DNA, 15 bp, Homo sapiens
ccagccctcccccca

SEQ ID NO: 82963 - DNA, 15 bp, Homo sapiens
cagccctccccccac

SEQ ID NO: 82964 - DNA, 15 bp, Homo sapiens
agccctccccccacc

SEQ ID NO: 82965 - DNA, 15 bp, Homo sapiens
gccctccccccaccc

SEQ ID NO: 82966 - DNA, 15 bp, Homo sapiens
ccctccccccacccc

SEQ ID NO: 82967 - DNA, 15 bp, Homo sapiens
cctccccccacccca

SEQ ID NO: 82968 - DNA, 15 bp, Homo sapiens
ctccccccaccccat

SEQ ID NO: 82969 - DNA, 15 bp, Homo sapiens
tccccccaccccatt

SEQ ID NO: 82970 - DNA, 15 bp, Homo sapiens
ccccccaccccattc

SEQ ID NO: 82971 - DNA, 15 bp, Homo sapiens
cccccaccccattcc

SEQ ID NO: 82972 - DNA, 15 bp, Homo sapiens
ccccaccccattcct

SEQ ID NO: 82973 - DNA, 15 bp, Homo sapiens
cccaccccattcctg

SEQ ID NO: 82974 - DNA, 15 bp, Homo sapiens
ccaccccattcctga

SEQ ID NO: 82975 - DNA, 15 bp, Homo sapiens
caccccattcctgaa

SEQ ID NO: 82976 - DNA, 15 bp, Homo sapiens
accccattcctgaag

SEQ ID NO: 82977 - DNA, 15 bp, Homo sapiens
ccccattcctgaagg

SEQ ID NO: 82978 - DNA, 15 bp, Homo sapiens
cccattcctgaaggc

SEQ ID NO: 82979 - DNA, 15 bp, Homo sapiens
ccattcctgaaggct

SEQ ID NO: 82980 - DNA, 15 bp, Homo sapiens
cattcctgaaggctg

SEQ ID NO: 82981 - DNA, 15 bp, Homo sapiens
attcctgaaggctgg

SEQ ID NO: 82982 - DNA, 15 bp, Homo sapiens
ttcctgaaggctggg

SEQ ID NO: 82983 - DNA, 15 bp, Homo sapiens
tcctgaaggctggga

SEQ ID NO: 82984 - DNA, 15 bp, Homo sapiens
cctgaaggctgggaa

SEQ ID NO: 82985 - DNA, 15 bp, Homo sapiens
ctgaaggctgggaac

SEQ ID NO: 82986 - DNA, 15 bp, Homo sapiens
tgaaggctgggaaca

SEQ ID NO: 82987 - DNA, 15 bp, Homo sapiens
gaaggctgggaacaa

SEQ ID NO: 82988 - DNA, 15 bp, Homo sapiens
aaggctgggaacaag

SEQ ID NO: 82989 - DNA, 15 bp, Homo sapiens
aggctgggaacaagg

SEQ ID NO: 82990 - DNA, 15 bp, Homo sapiens
ggctgggaacaagga

SEQ ID NO: 82991 - DNA, 15 bp, Homo sapiens
gctgggaacaaggag

SEQ ID NO: 82992 - DNA, 15 bp, Homo sapiens
ctgggaacaaggagg

SEQ ID NO: 82993 - DNA, 15 bp, Homo sapiens
tgggaacaaggaggg

SEQ ID NO: 82994 - DNA, 15 bp, Homo sapiens
gggaacaaggagggc

SEQ ID NO: 82995 - DNA, 15 bp, Homo sapiens
ggaacaaggagggct

SEQ ID NO: 82996 - DNA, 15 bp, Homo sapiens
gaacaaggagggctc

SEQ ID NO: 82997 - DNA, 15 bp, Homo sapiens
aacaaggagggctct

SEQ ID NO: 82998 - DNA, 15 bp, Homo sapiens
acaaggagggctctg

SEQ ID NO: 82999 - DNA, 15 bp, Homo sapiens
caaggagggctctgt

SEQ ID NO: 83000 - DNA, 15 bp, Homo sapiens
aaggagggctctgtc

SEQ ID NO: 83001 - DNA, 15 bp, Homo sapiens
aggagggctctgtct

SEQ ID NO: 83002 - DNA, 15 bp, Homo sapiens
ggagggctctgtctg

SEQ ID NO: 83003 - DNA, 15 bp, Homo sapiens
gagggctctgtctgg

SEQ ID NO: 83004 - DNA, 15 bp, Homo sapiens
agggctctgtctggt

SEQ ID NO: 83005 - DNA, 15 bp, Homo sapiens
gggctctgtctggta

SEQ ID NO: 83006 - DNA, 15 bp, Homo sapiens
ggctctgtctggtag

SEQ ID NO: 83007 - DNA, 15 bp, Homo sapiens
gctctgtctggtagc

SEQ ID NO: 83008 - DNA, 15 bp, Homo sapiens
ctctgtctggtagcc

SEQ ID NO: 83009 - DNA, 15 bp, Homo sapiens
tctgtctggtagcct

SEQ ID NO: 83010 - DNA, 15 bp, Homo sapiens
ctgtctggtagcctg

SEQ ID NO: 83011 - DNA, 15 bp, Homo sapiens
tgtctggtagcctga

SEQ ID NO: 83012 - DNA, 15 bp, Homo sapiens
gtctggtagcctgag

SEQ ID NO: 83013 - DNA, 15 bp, Homo sapiens
tctggtagcctgaga

SEQ ID NO: 83014 - DNA, 15 bp, Homo sapiens
ctggtagcctgagag

SEQ ID NO: 83015 - DNA, 15 bp, Homo sapiens
tggtagcctgagagc

SEQ ID NO: 83016 - DNA, 15 bp, Homo sapiens
ggtagcctgagagct

SEQ ID NO: 83017 - DNA, 15 bp, Homo sapiens
gtagcctgagagctg

SEQ ID NO: 83018 - DNA, 15 bp, Homo sapiens
tagcctgagagctgg

SEQ ID NO: 83019 - DNA, 15 bp, Homo sapiens
agcctgagagctggg

SEQ ID NO: 83020 - DNA, 15 bp, Homo sapiens
gcctgagagctgggc

SEQ ID NO: 83021 - DNA, 15 bp, Homo sapiens
cctgagagctgggcc

SEQ ID NO: 83022 - DNA, 15 bp, Homo sapiens
ctgagagctgggccc

SEQ ID NO: 83023 - DNA, 15 bp, Homo sapiens
tgagagctgggccct

SEQ ID NO: 83024 - DNA, 15 bp, Homo sapiens
gagagctgggccctg

SEQ ID NO: 83025 - DNA, 15 bp, Homo sapiens
agagctgggccctgc

SEQ ID NO: 83026 - DNA, 15 bp, Homo sapiens
gagctgggccctgcc

SEQ ID NO: 83027 - DNA, 15 bp, Homo sapiens
agctgggccctgccc

SEQ ID NO: 83028 - DNA, 15 bp, Homo sapiens
gctgggccctgccct

SEQ ID NO: 83029 - DNA, 15 bp, Homo sapiens
ctgggccctgccctt

SEQ ID NO: 83030 - DNA, 15 bp, Homo sapiens
tgggccctgcccttg

SEQ ID NO: 83031 - DNA, 15 bp, Homo sapiens
gggccctgcccttgg

SEQ ID NO: 83032 - DNA, 15 bp, Homo sapiens
ggccctgcccttgga

SEQ ID NO: 83033 - DNA, 15 bp, Homo sapiens
gccctgcccttggac

SEQ ID NO: 83034 - DNA, 15 bp, Homo sapiens
ccctgcccttggact

SEQ ID NO: 83035 - DNA, 15 bp, Homo sapiens
cctgcccttggactt

SEQ ID NO: 83036 - DNA, 15 bp, Homo sapiens
ctgcccttggacttc

SEQ ID NO: 83037 - DNA, 15 bp, Homo sapiens
tgcccttggacttct

SEQ ID NO: 83038 - DNA, 15 bp, Homo sapiens
gcccttggacttctc

SEQ ID NO: 83039 - DNA, 15 bp, Homo sapiens
cccttggacttctct

SEQ ID NO: 83040 - DNA, 15 bp, Homo sapiens
ccttggacttctctg

SEQ ID NO: 83041 - DNA, 15 bp, Homo sapiens
cttggacttctctga

SEQ ID NO: 83042 - DNA, 15 bp, Homo sapiens
ttggacttctctgag

SEQ ID NO: 83043 - DNA, 15 bp, Homo sapiens
tggacttctctgagg

SEQ ID NO: 83044 - DNA, 15 bp, Homo sapiens
ggacttctctgagga

SEQ ID NO: 83045 - DNA, 15 bp, Homo sapiens
gacttctctgaggaa

SEQ ID NO: 83046 - DNA, 15 bp, Homo sapiens
acttctctgaggaat

SEQ ID NO: 83047 - DNA, 15 bp, Homo sapiens
cttctctgaggaatt

SEQ ID NO: 83048 - DNA, 15 bp, Homo sapiens
ttctctgaggaattc

SEQ ID NO: 83049 - DNA, 15 bp, Homo sapiens
tctctgaggaattca

SEQ ID NO: 83050 - DNA, 15 bp, Homo sapiens
ctctgaggaattcag

SEQ ID NO: 83051 - DNA, 15 bp, Homo sapiens
tctgaggaattcagg

SEQ ID NO: 83052 - DNA, 15 bp, Homo sapiens
ctgaggaattcaggc

SEQ ID NO: 83053 - DNA, 15 bp, Homo sapiens
tgaggaattcaggcc

SEQ ID NO: 83054 - DNA, 15 bp, Homo sapiens
gaggaattcaggcct

SEQ ID NO: 83055 - DNA, 15 bp, Homo sapiens
aggaattcaggcctg

SEQ ID NO: 83056 - DNA, 15 bp, Homo sapiens
ggaattcaggcctga

SEQ ID NO: 83057 - DNA, 15 bp, Homo sapiens
gaattcaggcctgag

SEQ ID NO: 83058 - DNA, 15 bp, Homo sapiens
aattcaggcctgagg

SEQ ID NO: 83059 - DNA, 15 bp, Homo sapiens
attcaggcctgaggc

SEQ ID NO: 83060 - DNA, 15 bp, Homo sapiens
ttcaggcctgaggcc

SEQ ID NO: 83061 - DNA, 15 bp, Homo sapiens
tcaggcctgaggcca

SEQ ID NO: 83062 - DNA, 15 bp, Homo sapiens
caggcctgaggccag

SEQ ID NO: 83063 - DNA, 15 bp, Homo sapiens
aggcctgaggccagg

SEQ ID NO: 83064 - DNA, 15 bp, Homo sapiens
ggcctgaggccaggg

SEQ ID NO: 83065 - DNA, 15 bp, Homo sapiens
gcctgaggccaggga

SEQ ID NO: 83066 - DNA, 15 bp, Homo sapiens
cctgaggccagggag

SEQ ID NO: 83067 - DNA, 15 bp, Homo sapiens
ctgaggccagggagg

SEQ ID NO: 83068 - DNA, 15 bp, Homo sapiens
tgaggccagggaggc

SEQ ID NO: 83069 - DNA, 15 bp, Homo sapiens
gaggccagggaggca

SEQ ID NO: 83070 - DNA, 15 bp, Homo sapiens
aggccagggaggcag

SEQ ID NO: 83071 - DNA, 15 bp, Homo sapiens
ggccagggaggcagg

SEQ ID NO: 83072 - DNA, 15 bp, Homo sapiens
gccagggaggcaggg

SEQ ID NO: 83073 - DNA, 15 bp, Homo sapiens
ccagggaggcagggt

SEQ ID NO: 83074 - DNA, 15 bp, Homo sapiens
cagggaggcagggtg

SEQ ID NO: 83075 - DNA, 15 bp, Homo sapiens
agggaggcagggtgc

SEQ ID NO: 83076 - DNA, 15 bp, Homo sapiens
gggaggcagggtgct

SEQ ID NO: 83077 - DNA, 15 bp, Homo sapiens
ggaggcagggtgcta

SEQ ID NO: 83078 - DNA, 15 bp, Homo sapiens
gaggcagggtgctag

SEQ ID NO: 83079 - DNA, 15 bp, Homo sapiens
aggcagggtgctagg

SEQ ID NO: 83080 - DNA, 15 bp, Homo sapiens
ggcagggtgctaggc

SEQ ID NO: 83081 - DNA, 15 bp, Homo sapiens
gcagggtgctaggct

SEQ ID NO: 83082 - DNA, 15 bp, Homo sapiens
cagggtgctaggctg

SEQ ID NO: 83083 - DNA, 15 bp, Homo sapiens
agggtgctaggctgc

SEQ ID NO: 83084 - DNA, 15 bp, Homo sapiens
gggtgctaggctgcg

SEQ ID NO: 83085 - DNA, 15 bp, Homo sapiens
ggtgctaggctgcgg

SEQ ID NO: 83086 - DNA, 15 bp, Homo sapiens
gtgctaggctgcggg

SEQ ID NO: 83087 - DNA, 15 bp, Homo sapiens
tgctaggctgcgggc

SEQ ID NO: 83088 - DNA, 15 bp, Homo sapiens
gctaggctgcgggct

SEQ ID NO: 83089 - DNA, 15 bp, Homo sapiens
ctaggctgcgggctg

SEQ ID NO: 83090 - DNA, 15 bp, Homo sapiens
taggctgcgggctgg

SEQ ID NO: 83091 - DNA, 15 bp, Homo sapiens
aggctgcgggctggg

SEQ ID NO: 83092 - DNA, 15 bp, Homo sapiens
ggctgcgggctgggg

SEQ ID NO: 83093 - DNA, 15 bp, Homo sapiens
gctgcgggctgggga

SEQ ID NO: 83094 - DNA, 15 bp, Homo sapiens
ctgcgggctggggag

SEQ ID NO: 83095 - DNA, 15 bp, Homo sapiens
tgcgggctggggagc

SEQ ID NO: 83096 - DNA, 15 bp, Homo sapiens
gcgggctggggagcc

SEQ ID NO: 83097 - DNA, 15 bp, Homo sapiens
cgggctggggagcca

SEQ ID NO: 83098 - DNA, 15 bp, Homo sapiens
gggctggggagccac

SEQ ID NO: 83099 - DNA, 15 bp, Homo sapiens
ggctggggagccaca

SEQ ID NO: 83100 - DNA, 15 bp, Homo sapiens
gctggggagccacag

SEQ ID NO: 83101 - DNA, 15 bp, Homo sapiens
ctggggagccacagc

SEQ ID NO: 83102 - DNA, 15 bp, Homo sapiens
tggggagccacagca

SEQ ID NO: 83103 - DNA, 15 bp, Homo sapiens
ggggagccacagcat

SEQ ID NO: 83104 - DNA, 15 bp, Homo sapiens
gggagccacagcatg

SEQ ID NO: 83105 - DNA, 15 bp, Homo sapiens
ggagccacagcatga

SEQ ID NO: 83106 - DNA, 15 bp, Homo sapiens
gagccacagcatgag

SEQ ID NO: 83107 - DNA, 15 bp, Homo sapiens
agccacagcatgagg

SEQ ID NO: 83108 - DNA, 15 bp, Homo sapiens
gccacagcatgaggc

SEQ ID NO: 83109 - DNA, 15 bp, Homo sapiens
ccacagcatgaggct

SEQ ID NO: 83110 - DNA, 15 bp, Homo sapiens
cacagcatgaggcta

SEQ ID NO: 83111 - DNA, 15 bp, Homo sapiens
acagcatgaggctaa

SEQ ID NO: 83112 - DNA, 15 bp, Homo sapiens
cagcatgaggctaag

SEQ ID NO: 83113 - DNA, 15 bp, Homo sapiens
agcatgaggctaagg

SEQ ID NO: 83114 - DNA, 15 bp, Homo sapiens
gcatgaggctaaggg

SEQ ID NO: 83115 - DNA, 15 bp, Homo sapiens
catgaggctaaggga

SEQ ID NO: 83116 - DNA, 15 bp, Homo sapiens
atgaggctaagggag

SEQ ID NO: 83117 - DNA, 15 bp, Homo sapiens
tgaggctaagggagt

SEQ ID NO: 83118 - DNA, 15 bp, Homo sapiens
gaggctaagggagtg

SEQ ID NO: 83119 - DNA, 15 bp, Homo sapiens
aggctaagggagtgc

SEQ ID NO: 83120 - DNA, 15 bp, Homo sapiens
ggctaagggagtgcc

SEQ ID NO: 83121 - DNA, 15 bp, Homo sapiens
gctaagggagtgcca

SEQ ID NO: 83122 - DNA, 15 bp, Homo sapiens
ctaagggagtgccat

SEQ ID NO: 83123 - DNA, 15 bp, Homo sapiens
taagggagtgccatc

SEQ ID NO: 83124 - DNA, 15 bp, Homo sapiens
aagggagtgccatct

SEQ ID NO: 83125 - DNA, 15 bp, Homo sapiens
agggagtgccatctc

SEQ ID NO: 83126 - DNA, 15 bp, Homo sapiens
gggagtgccatctcc

SEQ ID NO: 83127 - DNA, 15 bp, Homo sapiens
ggagtgccatctcca

SEQ ID NO: 83128 - DNA, 15 bp, Homo sapiens
gagtgccatctccac

SEQ ID NO: 83129 - DNA, 15 bp, Homo sapiens
agtgccatctccacc

SEQ ID NO: 83130 - DNA, 15 bp, Homo sapiens
gtgccatctccaccc

SEQ ID NO: 83131 - DNA, 15 bp, Homo sapiens
tgccatctccacccc

SEQ ID NO: 83132 - DNA, 15 bp, Homo sapiens
gccatctccacccca

SEQ ID NO: 83133 - DNA, 15 bp, Homo sapiens
ccatctccaccccag

SEQ ID NO: 83134 - DNA, 15 bp, Homo sapiens
catctccaccccagg

SEQ ID NO: 83135 - DNA, 15 bp, Homo sapiens
atctccaccccagga

SEQ ID NO: 83136 - DNA, 15 bp, Homo sapiens
tctccaccccaggac

SEQ ID NO: 83137 - DNA, 15 bp, Homo sapiens
ctccaccccaggact

SEQ ID NO: 83138 - DNA, 15 bp, Homo sapiens
tccaccccaggactg

SEQ ID NO: 83139 - DNA, 15 bp, Homo sapiens
ccaccccaggactgg

SEQ ID NO: 83140 - DNA, 15 bp, Homo sapiens
caccccaggactggc

SEQ ID NO: 83141 - DNA, 15 bp, Homo sapiens
accccaggactggcc

SEQ ID NO: 83142 - DNA, 15 bp, Homo sapiens
ccccaggactggccc

SEQ ID NO: 83143 - DNA, 15 bp, Homo sapiens
cccaggactggccct

SEQ ID NO: 83144 - DNA, 15 bp, Homo sapiens
ccaggactggccctt

SEQ ID NO: 83145 - DNA, 15 bp, Homo sapiens
caggactggcccttg

SEQ ID NO: 83146 - DNA, 15 bp, Homo sapiens
aggactggcccttgg

SEQ ID NO: 83147 - DNA, 15 bp, Homo sapiens
ggactggcccttggc

SEQ ID NO: 83148 - DNA, 15 bp, Homo sapiens
gactggcccttggca

SEQ ID NO: 83149 - DNA, 15 bp, Homo sapiens
actggcccttggcag

SEQ ID NO: 83150 - DNA, 15 bp, Homo sapiens
ctggcccttggcagc

SEQ ID NO: 83151 - DNA, 15 bp, Homo sapiens
tggcccttggcagct

SEQ ID NO: 83152 - DNA, 15 bp, Homo sapiens
ggcccttggcagctc

SEQ ID NO: 83153 - DNA, 15 bp, Homo sapiens
gcccttggcagctct

SEQ ID NO: 83154 - DNA, 15 bp, Homo sapiens
cccttggcagctctg

SEQ ID NO: 83155 - DNA, 15 bp, Homo sapiens
ccttggcagctctgc

SEQ ID NO: 83156 - DNA, 15 bp, Homo sapiens
cttggcagctctgca

SEQ ID NO: 83157 - DNA, 15 bp, Homo sapiens
ttggcagctctgcat

SEQ ID NO: 83158 - DNA, 15 bp, Homo sapiens
tggcagctctgcatc

SEQ ID NO: 83159 - DNA, 15 bp, Homo sapiens
ggcagctctgcatca

SEQ ID NO: 83160 - DNA, 15 bp, Homo sapiens
gcagctctgcatcat

SEQ ID NO: 83161 - DNA, 15 bp, Homo sapiens
cagctctgcatcatc

SEQ ID NO: 83162 - DNA, 15 bp, Homo sapiens
agctctgcatcatcg

SEQ ID NO: 83163 - DNA, 15 bp, Homo sapiens
gctctgcatcatcgt

SEQ ID NO: 83164 - DNA, 15 bp, Homo sapiens
ctctgcatcatcgtc

SEQ ID NO: 83165 - DNA, 15 bp, Homo sapiens
tctgcatcatcgtcg

SEQ ID NO: 83166 - DNA, 15 bp, Homo sapiens
ctgcatcatcgtcgt

SEQ ID NO: 83167 - DNA, 15 bp, Homo sapiens
tgcatcatcgtcgtc

SEQ ID NO: 83168 - DNA, 15 bp, Homo sapiens
gcatcatcgtcgtca

SEQ ID NO: 83169 - DNA, 15 bp, Homo sapiens
catcatcgtcgtcag

SEQ ID NO: 83170 - DNA, 15 bp, Homo sapiens
atcatcgtcgtcaga

SEQ ID NO: 83171 - DNA, 15 bp, Homo sapiens
tcatcgtcgtcagag

SEQ ID NO: 83172 - DNA, 15 bp, Homo sapiens
catcgtcgtcagagc

SEQ ID NO: 83173 - DNA, 15 bp, Homo sapiens
atcgtcgtcagagcc

SEQ ID NO: 83174 - DNA, 15 bp, Homo sapiens
tcgtcgtcagagcca

SEQ ID NO: 83175 - DNA, 15 bp, Homo sapiens
cgtcgtcagagccac

SEQ ID NO: 83176 - DNA, 15 bp, Homo sapiens
gtcgtcagagccacc

SEQ ID NO: 83177 - DNA, 15 bp, Homo sapiens
tcgtcagagccaccg

SEQ ID NO: 83178 - DNA, 15 bp, Homo sapiens
cgtcagagccaccgc

SEQ ID NO: 83179 - DNA, 15 bp, Homo sapiens
gtcagagccaccgca

SEQ ID NO: 83180 - DNA, 15 bp, Homo sapiens
tcagagccaccgcag

SEQ ID NO: 83181 - DNA, 15 bp, Homo sapiens
cagagccaccgcaga

SEQ ID NO: 83182 - DNA, 15 bp, Homo sapiens
agagccaccgcagat

SEQ ID NO: 83183 - DNA, 15 bp, Homo sapiens
gagccaccgcagatt

SEQ ID NO: 83184 - DNA, 15 bp, Homo sapiens
agccaccgcagatta

SEQ ID NO: 83185 - DNA, 15 bp, Homo sapiens
gccaccgcagattat

SEQ ID NO: 83186 - DNA, 15 bp, Homo sapiens
ccaccgcagattatc

SEQ ID NO: 83187 - DNA, 15 bp, Homo sapiens
caccgcagattatca

SEQ ID NO: 83188 - DNA, 15 bp, Homo sapiens
accgcagattatcat

SEQ ID NO: 83189 - DNA, 15 bp, Homo sapiens
ccgcagattatcatc

SEQ ID NO: 83190 - DNA, 15 bp, Homo sapiens
cgcagattatcatca

SEQ ID NO: 83191 - DNA, 15 bp, Homo sapiens
gcagattatcatcaa

SEQ ID NO: 83192 - DNA, 15 bp, Homo sapiens
cagattatcatcaac

SEQ ID NO: 83193 - DNA, 15 bp, Homo sapiens
agattatcatcaacc

SEQ ID NO: 83194 - DNA, 15 bp, Homo sapiens
gattatcatcaaccc

SEQ ID NO: 83195 - DNA, 15 bp, Homo sapiens
attatcatcaaccct

SEQ ID NO: 83196 - DNA, 15 bp, Homo sapiens
ttatcatcaaccctg

SEQ ID NO: 83197 - DNA, 15 bp, Homo sapiens
tatcatcaaccctgc

SEQ ID NO: 83198 - DNA, 15 bp, Homo sapiens
atcatcaaccctgcc

SEQ ID NO: 83199 - DNA, 15 bp, Homo sapiens
tcatcaaccctgccc

SEQ ID NO: 83200 - DNA, 15 bp, Homo sapiens
catcaaccctgcccg

SEQ ID NO: 83201 - DNA, 15 bp, Homo sapiens
atcaaccctgcccga

SEQ ID NO: 83202 - DNA, 15 bp, Homo sapiens
tcaaccctgcccgac

SEQ ID NO: 83203 - DNA, 15 bp, Homo sapiens
caaccctgcccgaca

SEQ ID NO: 83204 - DNA, 15 bp, Homo sapiens
aaccctgcccgacag

SEQ ID NO: 83205 - DNA, 15 bp, Homo sapiens
accctgcccgacaga

SEQ ID NO: 83206 - DNA, 15 bp, Homo sapiens
ccctgcccgacagaa

SEQ ID NO: 83207 - DNA, 15 bp, Homo sapiens
cctgcccgacagaag

SEQ ID NO: 83208 - DNA, 15 bp, Homo sapiens
ctgcccgacagaaga

SEQ ID NO: 83209 - DNA, 15 bp, Homo sapiens
tgcccgacagaagat

SEQ ID NO: 83210 - DNA, 15 bp, Homo sapiens
gcccgacagaagatg

SEQ ID NO: 83211 - DNA, 15 bp, Homo sapiens
cccgacagaagatgg

SEQ ID NO: 83212 - DNA, 15 bp, Homo sapiens
ccgacagaagatggt

SEQ ID NO: 83213 - DNA, 15 bp, Homo sapiens
cgacagaagatggtc

SEQ ID NO: 83214 - DNA, 15 bp, Homo sapiens
gacagaagatggtcc

SEQ ID NO: 83215 - DNA, 15 bp, Homo sapiens
acagaagatggtcca

SEQ ID NO: 83216 - DNA, 15 bp, Homo sapiens
cagaagatggtccag

SEQ ID NO: 83217 - DNA, 15 bp, Homo sapiens
agaagatggtccaga

SEQ ID NO: 83218 - DNA, 15 bp, Homo sapiens
gaagatggtccagaa

SEQ ID NO: 83219 - DNA, 15 bp, Homo sapiens
aagatggtccagaag

SEQ ID NO: 83220 - DNA, 15 bp, Homo sapiens
agatggtccagaagc

SEQ ID NO: 83221 - DNA, 15 bp, Homo sapiens
gatggtccagaagct

SEQ ID NO: 83222 - DNA, 15 bp, Homo sapiens
atggtccagaagctg

SEQ ID NO: 83223 - DNA, 15 bp, Homo sapiens
tggtccagaagctgg

SEQ ID NO: 83224 - DNA, 15 bp, Homo sapiens
ggtccagaagctggc

SEQ ID NO: 83225 - DNA, 15 bp, Homo sapiens
gtccagaagctggcc

SEQ ID NO: 83226 - DNA, 15 bp, Homo sapiens
tccagaagctggccc

SEQ ID NO: 83227 - DNA, 15 bp, Homo sapiens
ccagaagctggccct

SEQ ID NO: 83228 - DNA, 15 bp, Homo sapiens
cagaagctggccctg

SEQ ID NO: 83229 - DNA, 15 bp, Homo sapiens
agaagctggccctgt

SEQ ID NO: 83230 - DNA, 15 bp, Homo sapiens
gaagctggccctgta

SEQ ID NO: 83231 - DNA, 15 bp, Homo sapiens
aagctggccctgtac

SEQ ID NO: 83232 - DNA, 15 bp, Homo sapiens
agctggccctgtacg

SEQ ID NO: 83233 - DNA, 15 bp, Homo sapiens
gctggccctgtacga

SEQ ID NO: 83234 - DNA, 15 bp, Homo sapiens
ctggccctgtacgag

SEQ ID NO: 83235 - DNA, 15 bp, Homo sapiens
tggccctgtacgagg

SEQ ID NO: 83236 - DNA, 15 bp, Homo sapiens
ggccctgtacgagga

SEQ ID NO: 83237 - DNA, 15 bp, Homo sapiens
gccctgtacgaggat

SEQ ID NO: 83238 - DNA, 15 bp, Homo sapiens
ccctgtacgaggatg

SEQ ID NO: 83239 - DNA, 15 bp, Homo sapiens
cctgtacgaggatgg

SEQ ID NO: 83240 - DNA, 15 bp, Homo sapiens
ctgtacgaggatggg

SEQ ID NO: 83241 - DNA, 15 bp, Homo sapiens
tgtacgaggatgggg

SEQ ID NO: 83242 - DNA, 15 bp, Homo sapiens
gtacgaggatggggc

SEQ ID NO: 83243 - DNA, 15 bp, Homo sapiens
tacgaggatggggcc

SEQ ID NO: 83244 - DNA, 15 bp, Homo sapiens
acgaggatggggccc

SEQ ID NO: 83245 - DNA, 15 bp, Homo sapiens
cgaggatggggccct

SEQ ID NO: 83246 - DNA, 15 bp, Homo sapiens
gaggatggggccctg

SEQ ID NO: 83247 - DNA, 15 bp, Homo sapiens
aggatggggccctgg

SEQ ID NO: 83248 - DNA, 15 bp, Homo sapiens
ggatggggccctgga

SEQ ID NO: 83249 - DNA, 15 bp, Homo sapiens
gatggggccctggac

SEQ ID NO: 83250 - DNA, 15 bp, Homo sapiens
atggggccctggaca

SEQ ID NO: 83251 - DNA, 15 bp, Homo sapiens
tggggccctggacag

SEQ ID NO: 83252 - DNA, 15 bp, Homo sapiens
ggggccctggacagc

SEQ ID NO: 83253 - DNA, 15 bp, Homo sapiens
gggccctggacagcc

SEQ ID NO: 83254 - DNA, 15 bp, Homo sapiens
ggccctggacagcct

SEQ ID NO: 83255 - DNA, 15 bp, Homo sapiens
gccctggacagcctg

SEQ ID NO: 83256 - DNA, 15 bp, Homo sapiens
ccctggacagcctgc

SEQ ID NO: 83257 - DNA, 15 bp, Homo sapiens
cctggacagcctgca

SEQ ID NO: 83258 - DNA, 15 bp, Homo sapiens
ctggacagcctgcag

SEQ ID NO: 83259 - DNA, 15 bp, Homo sapiens
tggacagcctgcagc

SEQ ID NO: 83260 - DNA, 15 bp, Homo sapiens
ggacagcctgcagct

SEQ ID NO: 83261 - DNA, 15 bp, Homo sapiens
gacagcctgcagctg

SEQ ID NO: 83262 - DNA, 15 bp, Homo sapiens
acagcctgcagctgc

SEQ ID NO: 83263 - DNA, 15 bp, Homo sapiens
cagcctgcagctgct

SEQ ID NO: 83264 - DNA, 15 bp, Homo sapiens
agcctgcagctgctg

SEQ ID NO: 83265 - DNA, 15 bp, Homo sapiens
gcctgcagctgctgt

SEQ ID NO: 83266 - DNA, 15 bp, Homo sapiens
cctgcagctgctgtc

SEQ ID NO: 83267 - DNA, 15 bp, Homo sapiens
ctgcagctgctgtcg

SEQ ID NO: 83268 - DNA, 15 bp, Homo sapiens
tgcagctgctgtcgt

SEQ ID NO: 83269 - DNA, 15 bp, Homo sapiens
gcagctgctgtcgtc

SEQ ID NO: 83270 - DNA, 15 bp, Homo sapiens
cagctgctgtcgtcc

SEQ ID NO: 83271 - DNA, 15 bp, Homo sapiens
agctgctgtcgtcca

SEQ ID NO: 83272 - DNA, 15 bp, Homo sapiens
gctgctgtcgtccag

SEQ ID NO: 83273 - DNA, 15 bp, Homo sapiens
ctgctgtcgtccagc

SEQ ID NO: 83274 - DNA, 15 bp, Homo sapiens
tgctgtcgtccagct

SEQ ID NO: 83275 - DNA, 15 bp, Homo sapiens
gctgtcgtccagctc

SEQ ID NO: 83276 - DNA, 15 bp, Homo sapiens
ctgtcgtccagctcc

SEQ ID NO: 83277 - DNA, 15 bp, Homo sapiens
tgtcgtccagctccc

SEQ ID NO: 83278 - DNA, 15 bp, Homo sapiens
gtcgtccagctccct

SEQ ID NO: 83279 - DNA, 15 bp, Homo sapiens
tcgtccagctccctc

SEQ ID NO: 83280 - DNA, 15 bp, Homo sapiens
cgtccagctccctcc

SEQ ID NO: 83281 - DNA, 15 bp, Homo sapiens
gtccagctccctccc

SEQ ID NO: 83282 - DNA, 15 bp, Homo sapiens
tccagctccctccca

SEQ ID NO: 83283 - DNA, 15 bp, Homo sapiens
ccagctccctcccag

SEQ ID NO: 83284 - DNA, 15 bp, Homo sapiens
cagctccctcccagg

SEQ ID NO: 83285 - DNA, 15 bp, Homo sapiens
agctccctcccaggt

SEQ ID NO: 83286 - DNA, 15 bp, Homo sapiens
gctccctcccaggtg

SEQ ID NO: 83287 - DNA, 15 bp, Homo sapiens
ctccctcccaggtgc

SEQ ID NO: 83288 - DNA, 15 bp, Homo sapiens
tccctcccaggtgct

SEQ ID NO: 83289 - DNA, 15 bp, Homo sapiens
ccctcccaggtgctg

SEQ ID NO: 83290 - DNA, 15 bp, Homo sapiens
cctcccaggtgctgc

SEQ ID NO: 83291 - DNA, 15 bp, Homo sapiens
ctcccaggtgctgcc

SEQ ID NO: 83292 - DNA, 15 bp, Homo sapiens
tcccaggtgctgccg

SEQ ID NO: 83293 - DNA, 15 bp, Homo sapiens
cccaggtgctgccgc

SEQ ID NO: 83294 - DNA, 15 bp, Homo sapiens
ccaggtgctgccgcc

SEQ ID NO: 83295 - DNA, 15 bp, Homo sapiens
caggtgctgccgccc

SEQ ID NO: 83296 - DNA, 15 bp, Homo sapiens
aggtgctgccgccca

SEQ ID NO: 83297 - DNA, 15 bp, Homo sapiens
ggtgctgccgcccag

SEQ ID NO: 83298 - DNA, 15 bp, Homo sapiens
gtgctgccgcccagg

SEQ ID NO: 83299 - DNA, 15 bp, Homo sapiens
tgctgccgcccaggc

SEQ ID NO: 83300 - DNA, 15 bp, Homo sapiens
gctgccgcccaggct

SEQ ID NO: 83301 - DNA, 15 bp, Homo sapiens
ctgccgcccaggctg

SEQ ID NO: 83302 - DNA, 15 bp, Homo sapiens
tgccgcccaggctgg

SEQ ID NO: 83303 - DNA, 15 bp, Homo sapiens
gccgcccaggctggc

SEQ ID NO: 83304 - DNA, 15 bp, Homo sapiens
ccgcccaggctggcc

SEQ ID NO: 83305 - DNA, 15 bp, Homo sapiens
cgcccaggctggcct

SEQ ID NO: 83306 - DNA, 15 bp, Homo sapiens
cccaggctggcctct

SEQ ID NO: 83307 - DNA, 15 bp, Homo sapiens
ccaggctggcctctg

SEQ ID NO: 83308 - DNA, 15 bp, Homo sapiens
caggctggcctctgg

SEQ ID NO: 83309 - DNA, 15 bp, Homo sapiens
aggctggcctctggg

SEQ ID NO: 83310 - DNA, 15 bp, Homo sapiens
ggctggcctctgggg

SEQ ID NO: 83311 - DNA, 15 bp, Homo sapiens
gctggcctctggggt

SEQ ID NO: 83312 - DNA, 15 bp, Homo sapiens
ctggcctctggggtg

SEQ ID NO: 83313 - DNA, 15 bp, Homo sapiens
tggcctctggggtgc

SEQ ID NO: 83314 - DNA, 15 bp, Homo sapiens
ggcctctggggtgct

SEQ ID NO: 83315 - DNA, 15 bp, Homo sapiens
gcctctggggtgctc

SEQ ID NO: 83316 - DNA, 15 bp, Homo sapiens
cctctggggtgctca

SEQ ID NO: 83317 - DNA, 15 bp, Homo sapiens
ctctggggtgctcag

SEQ ID NO: 83318 - DNA, 15 bp, Homo sapiens
tctggggtgctcagg

SEQ ID NO: 83319 - DNA, 15 bp, Homo sapiens
ctggggtgctcaggc

SEQ ID NO: 83320 - DNA, 15 bp, Homo sapiens
tggggtgctcaggcg

SEQ ID NO: 83321 - DNA, 15 bp, Homo sapiens
ggggtgctcaggcgc

SEQ ID NO: 83322 - DNA, 15 bp, Homo sapiens
gggtgctcaggcgca

SEQ ID NO: 83323 - DNA, 15 bp, Homo sapiens
ggtgctcaggcgcat

SEQ ID NO: 83324 - DNA, 15 bp, Homo sapiens
gtgctcaggcgcatc

SEQ ID NO: 83325 - DNA, 15 bp, Homo sapiens
tgctcaggcgcatcc

SEQ ID NO: 83326 - DNA, 15 bp, Homo sapiens
gctcaggcgcatccg

SEQ ID NO: 83327 - DNA, 15 bp, Homo sapiens
ctcaggcgcatccgt

SEQ ID NO: 83328 - DNA, 15 bp, Homo sapiens
tcaggcgcatccgtg

SEQ ID NO: 83329 - DNA, 15 bp, Homo sapiens
caggcgcatccgtgt

SEQ ID NO: 83330 - DNA, 15 bp, Homo sapiens
aggcgcatccgtgtc

SEQ ID NO: 83331 - DNA, 15 bp, Homo sapiens
ggcgcatccgtgtca

SEQ ID NO: 83332 - DNA, 15 bp, Homo sapiens
gcgcatccgtgtcag

SEQ ID NO: 83333 - DNA, 15 bp, Homo sapiens
cgcatccgtgtcagc

SEQ ID NO: 83334 - DNA, 15 bp, Homo sapiens
gcatccgtgtcagcc

SEQ ID NO: 83335 - DNA, 15 bp, Homo sapiens
catccgtgtcagccc

SEQ ID NO: 83336 - DNA, 15 bp, Homo sapiens
atccgtgtcagcccc

SEQ ID NO: 83337 - DNA, 15 bp, Homo sapiens
tccgtgtcagcccca

SEQ ID NO: 83338 - DNA, 15 bp, Homo sapiens
ccgtgtcagccccaa

SEQ ID NO: 83339 - DNA, 15 bp, Homo sapiens
cgtgtcagccccaaa

SEQ ID NO: 83340 - DNA, 15 bp, Homo sapiens
gtgtcagccccaaag

SEQ ID NO: 83341 - DNA, 15 bp, Homo sapiens
tgtcagccccaaaga

SEQ ID NO: 83342 - DNA, 15 bp, Homo sapiens
gtcagccccaaagag

SEQ ID NO: 83343 - DNA, 15 bp, Homo sapiens
tcagccccaaagagc

SEQ ID NO: 83344 - DNA, 15 bp, Homo sapiens
cagccccaaagagca

SEQ ID NO: 83345 - DNA, 15 bp, Homo sapiens
agccccaaagagcag

SEQ ID NO: 83346 - DNA, 15 bp, Homo sapiens
gccccaaagagcaga

SEQ ID NO: 83347 - DNA, 15 bp, Homo sapiens
ccccaaagagcagag

SEQ ID NO: 83348 - DNA, 15 bp, Homo sapiens
cccaaagagcagagt

SEQ ID NO: 83349 - DNA, 15 bp, Homo sapiens
ccaaagagcagagtg

SEQ ID NO: 83350 - DNA, 15 bp, Homo sapiens
caaagagcagagtgt

SEQ ID NO: 83351 - DNA, 15 bp, Homo sapiens
aaagagcagagtgtc

SEQ ID NO: 83352 - DNA, 15 bp, Homo sapiens
aagagcagagtgtct

SEQ ID NO: 83353 - DNA, 15 bp, Homo sapiens
agagcagagtgtctg

SEQ ID NO: 83354 - DNA, 15 bp, Homo sapiens
gagcagagtgtctgt

SEQ ID NO: 83355 - DNA, 15 bp, Homo sapiens
agcagagtgtctgtc

SEQ ID NO: 83356 - DNA, 15 bp, Homo sapiens
gcagagtgtctgtcc

SEQ ID NO: 83357 - DNA, 15 bp, Homo sapiens
cagagtgtctgtccc

SEQ ID NO: 83358 - DNA, 15 bp, Homo sapiens
agagtgtctgtcccg

SEQ ID NO: 83359 - DNA, 15 bp, Homo sapiens
gagtgtctgtcccga

SEQ ID NO: 83360 - DNA, 15 bp, Homo sapiens
agtgtctgtcccgac

SEQ ID NO: 83361 - DNA, 15 bp, Homo sapiens
gtgtctgtcccgact

SEQ ID NO: 83362 - DNA, 15 bp, Homo sapiens
tgtctgtcccgactg

SEQ ID NO: 83363 - DNA, 15 bp, Homo sapiens
gtctgtcccgactgc

SEQ ID NO: 83364 - DNA, 15 bp, Homo sapiens
tctgtcccgactgcg

SEQ ID NO: 83365 - DNA, 15 bp, Homo sapiens
ctgtcccgactgcgc

SEQ ID NO: 83366 - DNA, 15 bp, Homo sapiens
tgtcccgactgcgct

SEQ ID NO: 83367 - DNA, 15 bp, Homo sapiens
gtcccgactgcgctg

SEQ ID NO: 83368 - DNA, 15 bp, Homo sapiens
tcccgactgcgctga

SEQ ID NO: 83369 - DNA, 15 bp, Homo sapiens
cccgactgcgctgag

SEQ ID NO: 83370 - DNA, 15 bp, Homo sapiens
ccgactgcgctgagg

SEQ ID NO: 83371 - DNA, 15 bp, Homo sapiens
cgactgcgctgaggg

SEQ ID NO: 83372 - DNA, 15 bp, Homo sapiens
gactgcgctgagggc

SEQ ID NO: 83373 - DNA, 15 bp, Homo sapiens
actgcgctgagggcg

SEQ ID NO: 83374 - DNA, 15 bp, Homo sapiens
ctgcgctgagggcgt

SEQ ID NO: 83375 - DNA, 15 bp, Homo sapiens
tgcgctgagggcgtg

SEQ ID NO: 83376 - DNA, 15 bp, Homo sapiens
gcgctgagggcgtgg

SEQ ID NO: 83377 - DNA, 15 bp, Homo sapiens
cgctgagggcgtggg

SEQ ID NO: 83378 - DNA, 15 bp, Homo sapiens
gctgagggcgtgggg

SEQ ID NO: 83379 - DNA, 15 bp, Homo sapiens
ctgagggcgtggggc

SEQ ID NO: 83380 - DNA, 15 bp, Homo sapiens
tgagggcgtggggca

SEQ ID NO: 83381 - DNA, 15 bp, Homo sapiens
gagggcgtggggcag

SEQ ID NO: 83382 - DNA, 15 bp, Homo sapiens
agggcgtggggcagc

SEQ ID NO: 83383 - DNA, 15 bp, Homo sapiens
gggcgtggggcagcc

SEQ ID NO: 83384 - DNA, 15 bp, Homo sapiens
ggcgtggggcagccg

SEQ ID NO: 83385 - DNA, 15 bp, Homo sapiens
gcgtggggcagccgg

SEQ ID NO: 83386 - DNA, 15 bp, Homo sapiens
cgtggggcagccggg

SEQ ID NO: 83387 - DNA, 15 bp, Homo sapiens
gtggggcagccgggc

SEQ ID NO: 83388 - DNA, 15 bp, Homo sapiens
tggggcagccgggca

SEQ ID NO: 83389 - DNA, 15 bp, Homo sapiens
ggggcagccgggcag

SEQ ID NO: 83390 - DNA, 15 bp, Homo sapiens
gggcagccgggcagg

SEQ ID NO: 83391 - DNA, 15 bp, Homo sapiens
ggcagccgggcaggc

SEQ ID NO: 83392 - DNA, 15 bp, Homo sapiens
gcagccgggcaggcc

SEQ ID NO: 83393 - DNA, 15 bp, Homo sapiens
cagccgggcaggcca

SEQ ID NO: 83394 - DNA, 15 bp, Homo sapiens
agccgggcaggccac

SEQ ID NO: 83395 - DNA, 15 bp, Homo sapiens
gccgggcaggccact

SEQ ID NO: 83396 - DNA, 15 bp, Homo sapiens
ccgggcaggccactg

SEQ ID NO: 83397 - DNA, 15 bp, Homo sapiens
cgggcaggccactgg

SEQ ID NO: 83398 - DNA, 15 bp, Homo sapiens
gggcaggccactggc

SEQ ID NO: 83399 - DNA, 15 bp, Homo sapiens
ggcaggccactggct

SEQ ID NO: 83400 - DNA, 15 bp, Homo sapiens
gcaggccactggctc

SEQ ID NO: 83401 - DNA, 15 bp, Homo sapiens
caggccactggctct

SEQ ID NO: 83402 - DNA, 15 bp, Homo sapiens
aggccactggctctg

SEQ ID NO: 83403 - DNA, 15 bp, Homo sapiens
ggccactggctctgg

SEQ ID NO: 83404 - DNA, 15 bp, Homo sapiens
gccactggctctggc

SEQ ID NO: 83405 - DNA, 15 bp, Homo sapiens
ccactggctctggcg

SEQ ID NO: 83406 - DNA, 15 bp, Homo sapiens
cactggctctggcga

SEQ ID NO: 83407 - DNA, 15 bp, Homo sapiens
actggctctggcgac

SEQ ID NO: 83408 - DNA, 15 bp, Homo sapiens
ctggctctggcgacc

SEQ ID NO: 83409 - DNA, 15 bp, Homo sapiens
tggctctggcgacct

SEQ ID NO: 83410 - DNA, 15 bp, Homo sapiens
ggctctggcgacctc

SEQ ID NO: 83411 - DNA, 15 bp, Homo sapiens
gctctggcgacctct

SEQ ID NO: 83412 - DNA, 15 bp, Homo sapiens
ctctggcgacctcta

SEQ ID NO: 83413 - DNA, 15 bp, Homo sapiens
tctggcgacctctag

SEQ ID NO: 83414 - DNA, 15 bp, Homo sapiens
ctggcgacctctaga

SEQ ID NO: 83415 - DNA, 15 bp, Homo sapiens
tggcgacctctagaa

SEQ ID NO: 83416 - DNA, 15 bp, Homo sapiens
ggcgacctctagaag

SEQ ID NO: 83417 - DNA, 15 bp, Homo sapiens
gcgacctctagaagc

SEQ ID NO: 83418 - DNA, 15 bp, Homo sapiens
cgacctctagaagcc

SEQ ID NO: 83419 - DNA, 15 bp, Homo sapiens
gacctctagaagccc

SEQ ID NO: 83420 - DNA, 15 bp, Homo sapiens
acctctagaagccca

SEQ ID NO: 83421 - DNA, 15 bp, Homo sapiens
cctctagaagcccag

SEQ ID NO: 83422 - DNA, 15 bp, Homo sapiens
ctctagaagcccagc

SEQ ID NO: 83423 - DNA, 15 bp, Homo sapiens
tctagaagcccagcc

SEQ ID NO: 83424 - DNA, 15 bp, Homo sapiens
ctagaagcccagccg

SEQ ID NO: 83425 - DNA, 15 bp, Homo sapiens
tagaagcccagccgg

SEQ ID NO: 83426 - DNA, 15 bp, Homo sapiens
agaagcccagccggc

SEQ ID NO: 83427 - DNA, 15 bp, Homo sapiens
gaagcccagccggcc

SEQ ID NO: 83428 - DNA, 15 bp, Homo sapiens
aagcccagccggccc

SEQ ID NO: 83429 - DNA, 15 bp, Homo sapiens
agcccagccggcccc

SEQ ID NO: 83430 - DNA, 15 bp, Homo sapiens
gcccagccggcccca

SEQ ID NO: 83431 - DNA, 15 bp, Homo sapiens
cccagccggccccac

SEQ ID NO: 83432 - DNA, 15 bp, Homo sapiens
ccagccggccccaca

SEQ ID NO: 83433 - DNA, 15 bp, Homo sapiens
cagccggccccacat

SEQ ID NO: 83434 - DNA, 15 bp, Homo sapiens
agccggccccacatg

SEQ ID NO: 83435 - DNA, 15 bp, Homo sapiens
gccggccccacatgc

SEQ ID NO: 83436 - DNA, 15 bp, Homo sapiens
ccggccccacatgcc

SEQ ID NO: 83437 - DNA, 15 bp, Homo sapiens
cggccccacatgcct

SEQ ID NO: 83438 - DNA, 15 bp, Homo sapiens
ggccccacatgcctc

SEQ ID NO: 83439 - DNA, 15 bp, Homo sapiens
gccccacatgcctcc

SEQ ID NO: 83440 - DNA, 15 bp, Homo sapiens
ccccacatgcctccc

SEQ ID NO: 83441 - DNA, 15 bp, Homo sapiens
cccacatgcctccct

SEQ ID NO: 83442 - DNA, 15 bp, Homo sapiens
ccacatgcctccctt

SEQ ID NO: 83443 - DNA, 15 bp, Homo sapiens
cacatgcctccctta

SEQ ID NO: 83444 - DNA, 15 bp, Homo sapiens
acatgcctcccttag

SEQ ID NO: 83445 - DNA, 15 bp, Homo sapiens
catgcctcccttagc

SEQ ID NO: 83446 - DNA, 15 bp, Homo sapiens
atgcctcccttagca

SEQ ID NO: 83447 - DNA, 15 bp, Homo sapiens
tgcctcccttagcaa

SEQ ID NO: 83448 - DNA, 15 bp, Homo sapiens
gcctcccttagcaag

SEQ ID NO: 83449 - DNA, 15 bp, Homo sapiens
cctcccttagcaaga

SEQ ID NO: 83450 - DNA, 15 bp, Homo sapiens
ctcccttagcaagac

SEQ ID NO: 83451 - DNA, 15 bp, Homo sapiens
tcccttagcaagacc

SEQ ID NO: 83452 - DNA, 15 bp, Homo sapiens
cccttagcaagaccc

SEQ ID NO: 83453 - DNA, 15 bp, Homo sapiens
ccttagcaagaccct

SEQ ID NO: 83454 - DNA, 15 bp, Homo sapiens
cttagcaagaccctg

SEQ ID NO: 83455 - DNA, 15 bp, Homo sapiens
ttagcaagaccctgg

SEQ ID NO: 83456 - DNA, 15 bp, Homo sapiens
tagcaagaccctggc

SEQ ID NO: 83457 - DNA, 15 bp, Homo sapiens
agcaagaccctggcc

SEQ ID NO: 83458 - DNA, 15 bp, Homo sapiens
gcaagaccctggccc

SEQ ID NO: 83459 - DNA, 15 bp, Homo sapiens
caagaccctggccca

SEQ ID NO: 83460 - DNA, 15 bp, Homo sapiens
aagaccctggcccac

SEQ ID NO: 83461 - DNA, 15 bp, Homo sapiens
agaccctggcccact

SEQ ID NO: 83462 - DNA, 15 bp, Homo sapiens
gaccctggcccactc

SEQ ID NO: 83463 - DNA, 15 bp, Homo sapiens
accctggcccactcc

SEQ ID NO: 83464 - DNA, 15 bp, Homo sapiens
ccctggcccactcct

SEQ ID NO: 83465 - DNA, 15 bp, Homo sapiens
cctggcccactcctt

SEQ ID NO: 83466 - DNA, 15 bp, Homo sapiens
ctggcccactccttc

SEQ ID NO: 83467 - DNA, 15 bp, Homo sapiens
tggcccactccttcc

SEQ ID NO: 83468 - DNA, 15 bp, Homo sapiens
ggcccactccttccc

SEQ ID NO: 83469 - DNA, 15 bp, Homo sapiens
gcccactccttccct

SEQ ID NO: 83470 - DNA, 15 bp, Homo sapiens
cccactccttccctc

SEQ ID NO: 83471 - DNA, 15 bp, Homo sapiens
ccactccttccctcg

SEQ ID NO: 83472 - DNA, 15 bp, Homo sapiens
cactccttccctcgc

SEQ ID NO: 83473 - DNA, 15 bp, Homo sapiens
actccttccctcgcc

SEQ ID NO: 83474 - DNA, 15 bp, Homo sapiens
ctccttccctcgcct

SEQ ID NO: 83475 - DNA, 15 bp, Homo sapiens
tccttccctcgcctc

SEQ ID NO: 83476 - DNA, 15 bp, Homo sapiens
ccttccctcgcctcc

SEQ ID NO: 83477 - DNA, 15 bp, Homo sapiens
cttccctcgcctcct

SEQ ID NO: 83478 - DNA, 15 bp, Homo sapiens
ttccctcgcctcctg

SEQ ID NO: 83479 - DNA, 15 bp, Homo sapiens
tccctcgcctcctga

SEQ ID NO: 83480 - DNA, 15 bp, Homo sapiens
ccctcgcctcctgac

SEQ ID NO: 83481 - DNA, 15 bp, Homo sapiens
cctcgcctcctgaca

SEQ ID NO: 83482 - DNA, 15 bp, Homo sapiens
ctcgcctcctgacag

SEQ ID NO: 83483 - DNA, 15 bp, Homo sapiens
tcgcctcctgacagt

SEQ ID NO: 83484 - DNA, 15 bp, Homo sapiens
cgcctcctgacagta

SEQ ID NO: 83485 - DNA, 15 bp, Homo sapiens
gcctcctgacagtag

SEQ ID NO: 83486 - DNA, 15 bp, Homo sapiens
cctcctgacagtagc

SEQ ID NO: 83487 - DNA, 15 bp, Homo sapiens
ctcctgacagtagca

SEQ ID NO: 83488 - DNA, 15 bp, Homo sapiens
tcctgacagtagcac

SEQ ID NO: 83489 - DNA, 15 bp, Homo sapiens
cctgacagtagcacc

SEQ ID NO: 83490 - DNA, 15 bp, Homo sapiens
ctgacagtagcacct

SEQ ID NO: 83491 - DNA, 15 bp, Homo sapiens
tgacagtagcacctc

SEQ ID NO: 83492 - DNA, 15 bp, Homo sapiens
gacagtagcacctcc

SEQ ID NO: 83493 - DNA, 15 bp, Homo sapiens
acagtagcacctcct

SEQ ID NO: 83494 - DNA, 15 bp, Homo sapiens
cagtagcacctcctt

SEQ ID NO: 83495 - DNA, 15 bp, Homo sapiens
agtagcacctccttt

SEQ ID NO: 83496 - DNA, 15 bp, Homo sapiens
gtagcacctccttta

SEQ ID NO: 83497 - DNA, 15 bp, Homo sapiens
tagcacctcctttag

SEQ ID NO: 83498 - DNA, 15 bp, Homo sapiens
agcacctcctttagc

SEQ ID NO: 83499 - DNA, 15 bp, Homo sapiens
gcacctcctttagcc

SEQ ID NO: 83500 - DNA, 15 bp, Homo sapiens
cacctcctttagccc

SEQ ID NO: 83501 - DNA, 15 bp, Homo sapiens
acctcctttagcccg

SEQ ID NO: 83502 - DNA, 15 bp, Homo sapiens
cctcctttagcccga

SEQ ID NO: 83503 - DNA, 15 bp, Homo sapiens
ctcctttagcccgag

SEQ ID NO: 83504 - DNA, 15 bp, Homo sapiens
tcctttagcccgagg

SEQ ID NO: 83505 - DNA, 15 bp, Homo sapiens
cctttagcccgaggg

SEQ ID NO: 83506 - DNA, 15 bp, Homo sapiens
ctttagcccgagggt

SEQ ID NO: 83507 - DNA, 15 bp, Homo sapiens
tttagcccgagggtg

SEQ ID NO: 83508 - DNA, 15 bp, Homo sapiens
ttagcccgagggtgc

SEQ ID NO: 83509 - DNA, 15 bp, Homo sapiens
tagcccgagggtgcc

SEQ ID NO: 83510 - DNA, 15 bp, Homo sapiens
agcccgagggtgcct

SEQ ID NO: 83511 - DNA, 15 bp, Homo sapiens
gcccgagggtgcctg

SEQ ID NO: 83512 - DNA, 15 bp, Homo sapiens
cccgagggtgcctgc

SEQ ID NO: 83513 - DNA, 15 bp, Homo sapiens
ccgagggtgcctgcc

SEQ ID NO: 83514 - DNA, 15 bp, Homo sapiens
cgagggtgcctgccc

SEQ ID NO: 83515 - DNA, 15 bp, Homo sapiens
gagggtgcctgcccc

SEQ ID NO: 83516 - DNA, 15 bp, Homo sapiens
agggtgcctgcccca

SEQ ID NO: 83517 - DNA, 15 bp, Homo sapiens
gggtgcctgccccac

SEQ ID NO: 83518 - DNA, 15 bp, Homo sapiens
ggtgcctgccccact

SEQ ID NO: 83519 - DNA, 15 bp, Homo sapiens
gtgcctgccccactc

SEQ ID NO: 83520 - DNA, 15 bp, Homo sapiens
tgcctgccccactct

SEQ ID NO: 83521 - DNA, 15 bp, Homo sapiens
gcctgccccactctg

SEQ ID NO: 83522 - DNA, 15 bp, Homo sapiens
cctgccccactctgt

SEQ ID NO: 83523 - DNA, 15 bp, Homo sapiens
ctgccccactctgtg

SEQ ID NO: 83524 - DNA, 15 bp, Homo sapiens
tgccccactctgtgc

SEQ ID NO: 83525 - DNA, 15 bp, Homo sapiens
gccccactctgtgct

SEQ ID NO: 83526 - DNA, 15 bp, Homo sapiens
ccccactctgtgctt

SEQ ID NO: 83527 - DNA, 15 bp, Homo sapiens
cccactctgtgcttt

SEQ ID NO: 83528 - DNA, 15 bp, Homo sapiens
ccactctgtgctttc

SEQ ID NO: 83529 - DNA, 15 bp, Homo sapiens
cactctgtgctttca

SEQ ID NO: 83530 - DNA, 15 bp, Homo sapiens
actctgtgctttcag

SEQ ID NO: 83531 - DNA, 15 bp, Homo sapiens
ctctgtgctttcagg

SEQ ID NO: 83532 - DNA, 15 bp, Homo sapiens
tctgtgctttcagga

SEQ ID NO: 83533 - DNA, 15 bp, Homo sapiens
ctgtgctttcaggaa

SEQ ID NO: 83534 - DNA, 15 bp, Homo sapiens
tgtgctttcaggaaa

SEQ ID NO: 83535 - DNA, 15 bp, Homo sapiens
gtgctttcaggaaat

SEQ ID NO: 83536 - DNA, 15 bp, Homo sapiens
tgctttcaggaaata

SEQ ID NO: 83537 - DNA, 15 bp, Homo sapiens
gctttcaggaaatag

SEQ ID NO: 83538 - DNA, 15 bp, Homo sapiens
ctttcaggaaatagg

SEQ ID NO: 83539 - DNA, 15 bp, Homo sapiens
tttcaggaaatagga

SEQ ID NO: 83540 - DNA, 15 bp, Homo sapiens
ttcaggaaataggaa

SEQ ID NO: 83541 - DNA, 15 bp, Homo sapiens
tcaggaaataggaag

SEQ ID NO: 83542 - DNA, 15 bp, Homo sapiens
caggaaataggaagc

SEQ ID NO: 83543 - DNA, 15 bp, Homo sapiens
aggaaataggaagcc

SEQ ID NO: 83544 - DNA, 15 bp, Homo sapiens
ggaaataggaagccc

SEQ ID NO: 83545 - DNA, 15 bp, Homo sapiens
gaaataggaagcccc

SEQ ID NO: 83546 - DNA, 15 bp, Homo sapiens
aaataggaagcccca

SEQ ID NO: 83547 - DNA, 15 bp, Homo sapiens
aataggaagccccag

SEQ ID NO: 83548 - DNA, 15 bp, Homo sapiens
ataggaagccccagc

SEQ ID NO: 83549 - DNA, 15 bp, Homo sapiens
taggaagccccagca

SEQ ID NO: 83550 - DNA, 15 bp, Homo sapiens
aggaagccccagcag

SEQ ID NO: 83551 - DNA, 15 bp, Homo sapiens
ggaagccccagcagg

SEQ ID NO: 83552 - DNA, 15 bp, Homo sapiens
gaagccccagcagga

SEQ ID NO: 83553 - DNA, 15 bp, Homo sapiens
aagccccagcaggaa

SEQ ID NO: 83554 - DNA, 15 bp, Homo sapiens
agccccagcaggaat

SEQ ID NO: 83555 - DNA, 15 bp, Homo sapiens
gccccagcaggaatt

SEQ ID NO: 83556 - DNA, 15 bp, Homo sapiens
ccccagcaggaattt

SEQ ID NO: 83557 - DNA, 15 bp, Homo sapiens
cccagcaggaatttt

SEQ ID NO: 83558 - DNA, 15 bp, Homo sapiens
ccagcaggaattttc

SEQ ID NO: 83559 - DNA, 15 bp, Homo sapiens
cagcaggaattttcc

SEQ ID NO: 83560 - DNA, 15 bp, Homo sapiens
agcaggaattttcca

SEQ ID NO: 83561 - DNA, 15 bp, Homo sapiens
gcaggaattttccat

SEQ ID NO: 83562 - DNA, 15 bp, Homo sapiens
caggaattttccatc

SEQ ID NO: 83563 - DNA, 15 bp, Homo sapiens
aggaattttccatcc

SEQ ID NO: 83564 - DNA, 15 bp, Homo sapiens
ggaattttccatccc

SEQ ID NO: 83565 - DNA, 15 bp, Homo sapiens
gaattttccatccca

SEQ ID NO: 83566 - DNA, 15 bp, Homo sapiens
aattttccatcccag

SEQ ID NO: 83567 - DNA, 15 bp, Homo sapiens
attttccatcccagg

SEQ ID NO: 83568 - DNA, 15 bp, Homo sapiens
ttttccatcccaggt

SEQ ID NO: 83569 - DNA, 15 bp, Homo sapiens
tttccatcccaggta

SEQ ID NO: 83570 - DNA, 15 bp, Homo sapiens
ttccatcccaggtac

SEQ ID NO: 83571 - DNA, 15 bp, Homo sapiens
tccatcccaggtact

SEQ ID NO: 83572 - DNA, 15 bp, Homo sapiens
ccatcccaggtacta

SEQ ID NO: 83573 - DNA, 15 bp, Homo sapiens
catcccaggtactat

SEQ ID NO: 83574 - DNA, 15 bp, Homo sapiens
atcccaggtactatt

SEQ ID NO: 83575 - DNA, 15 bp, Homo sapiens
tcccaggtactattt

SEQ ID NO: 83576 - DNA, 15 bp, Homo sapiens
cccaggtactatttg

SEQ ID NO: 83577 - DNA, 15 bp, Homo sapiens
ccaggtactatttga

SEQ ID NO: 83578 - DNA, 15 bp, Homo sapiens
caggtactatttgaa

SEQ ID NO: 83579 - DNA, 15 bp, Homo sapiens
aggtactatttgaag

SEQ ID NO: 83580 - DNA, 15 bp, Homo sapiens
ggtactatttgaaga

SEQ ID NO: 83581 - DNA, 15 bp, Homo sapiens
gtactatttgaagaa

SEQ ID NO: 83582 - DNA, 15 bp, Homo sapiens
tactatttgaagaac

SEQ ID NO: 83583 - DNA, 15 bp, Homo sapiens
actatttgaagaacc

SEQ ID NO: 83584 - DNA, 15 bp, Homo sapiens
ctatttgaagaacca

SEQ ID NO: 83585 - DNA, 15 bp, Homo sapiens
tatttgaagaaccac

SEQ ID NO: 83586 - DNA, 15 bp, Homo sapiens
atttgaagaaccact

SEQ ID NO: 83587 - DNA, 15 bp, Homo sapiens
tttgaagaaccactg

SEQ ID NO: 83588 - DNA, 15 bp, Homo sapiens
ttgaagaaccactgc

SEQ ID NO: 83589 - DNA, 15 bp, Homo sapiens
tgaagaaccactgct

SEQ ID NO: 83590 - DNA, 15 bp, Homo sapiens
gaagaaccactgctt

SEQ ID NO: 83591 - DNA, 15 bp, Homo sapiens
aagaaccactgctta

SEQ ID NO: 83592 - DNA, 15 bp, Homo sapiens
agaaccactgcttag

SEQ ID NO: 83593 - DNA, 15 bp, Homo sapiens
gaaccactgcttagg

SEQ ID NO: 83594 - DNA, 15 bp, Homo sapiens
aaccactgcttagga

SEQ ID NO: 83595 - DNA, 15 bp, Homo sapiens
accactgcttaggaa

SEQ ID NO: 83596 - DNA, 15 bp, Homo sapiens
ccactgcttaggaac

SEQ ID NO: 83597 - DNA, 15 bp, Homo sapiens
cactgcttaggaacc

SEQ ID NO: 83598 - DNA, 15 bp, Homo sapiens
actgcttaggaaccc

SEQ ID NO: 83599 - DNA, 15 bp, Homo sapiens
ctgcttaggaaccct

SEQ ID NO: 83600 - DNA, 15 bp, Homo sapiens
tgcttaggaaccctc

SEQ ID NO: 83601 - DNA, 15 bp, Homo sapiens
gcttaggaaccctca

SEQ ID NO: 83602 - DNA, 15 bp, Homo sapiens
cttaggaaccctcag

SEQ ID NO: 83603 - DNA, 15 bp, Homo sapiens
ttaggaaccctcagc

SEQ ID NO: 83604 - DNA, 15 bp, Homo sapiens
taggaaccctcagct

SEQ ID NO: 83605 - DNA, 15 bp, Homo sapiens
aggaaccctcagctg

SEQ ID NO: 83606 - DNA, 15 bp, Homo sapiens
ggaaccctcagctgg

SEQ ID NO: 83607 - DNA, 15 bp, Homo sapiens
gaaccctcagctggg

SEQ ID NO: 83608 - DNA, 15 bp, Homo sapiens
aaccctcagctgggc

SEQ ID NO: 83609 - DNA, 15 bp, Homo sapiens
accctcagctgggcg

SEQ ID NO: 83610 - DNA, 15 bp, Homo sapiens
ccctcagctgggcga

SEQ ID NO: 83611 - DNA, 15 bp, Homo sapiens
cctcagctgggcgag

SEQ ID NO: 83612 - DNA, 15 bp, Homo sapiens
ctcagctgggcgagg

SEQ ID NO: 83613 - DNA, 15 bp, Homo sapiens
tcagctgggcgaggt

SEQ ID NO: 83614 - DNA, 15 bp, Homo sapiens
cagctgggcgaggtg

SEQ ID NO: 83615 - DNA, 15 bp, Homo sapiens
agctgggcgaggtgg

SEQ ID NO: 83616 - DNA, 15 bp, Homo sapiens
gctgggcgaggtggc

SEQ ID NO: 83617 - DNA, 15 bp, Homo sapiens
ctgggcgaggtggct

SEQ ID NO: 83618 - DNA, 15 bp, Homo sapiens
tgggcgaggtggctc

SEQ ID NO: 83619 - DNA, 15 bp, Homo sapiens
gggcgaggtggctca

SEQ ID NO: 83620 - DNA, 15 bp, Homo sapiens
ggcgaggtggctcat

SEQ ID NO: 83621 - DNA, 15 bp, Homo sapiens
gcgaggtggctcatg

SEQ ID NO: 83622 - DNA, 15 bp, Homo sapiens
cgaggtggctcatgc

SEQ ID NO: 83623 - DNA, 15 bp, Homo sapiens
ggtggctcatgccta

SEQ ID NO: 83624 - DNA, 15 bp, Homo sapiens
gtggctcatgcctat

SEQ ID NO: 83625 - DNA, 15 bp, Homo sapiens
tggctcatgcctata

SEQ ID NO: 83626 - DNA, 15 bp, Homo sapiens
ggctcatgcctataa

SEQ ID NO: 83627 - DNA, 15 bp, Homo sapiens
gctcatgcctataat

SEQ ID NO: 83628 - DNA, 15 bp, Homo sapiens
ctcatgcctataata

SEQ ID NO: 83629 - DNA, 15 bp, Homo sapiens
tcatgcctataatac

SEQ ID NO: 83630 - DNA, 15 bp, Homo sapiens
catgcctataatacc

SEQ ID NO: 83631 - DNA, 15 bp, Homo sapiens
atgcctataatacca

SEQ ID NO: 83632 - DNA, 15 bp, Homo sapiens
tgcctataataccag

SEQ ID NO: 83633 - DNA, 15 bp, Homo sapiens
gcctataataccagc

SEQ ID NO: 83634 - DNA, 15 bp, Homo sapiens
cctataataccagca

SEQ ID NO: 83635 - DNA, 15 bp, Homo sapiens
ctataataccagcac

SEQ ID NO: 83636 - DNA, 15 bp, Homo sapiens
tataataccagcact

SEQ ID NO: 83637 - DNA, 15 bp, Homo sapiens
ataataccagcactt

SEQ ID NO: 83638 - DNA, 15 bp, Homo sapiens
taataccagcacttt

SEQ ID NO: 83639 - DNA, 15 bp, Homo sapiens
aataccagcactttt

SEQ ID NO: 83640 - DNA, 15 bp, Homo sapiens
ataccagcacttttg

SEQ ID NO: 83641 - DNA, 15 bp, Homo sapiens
taccagcacttttgg

SEQ ID NO: 83642 - DNA, 15 bp, Homo sapiens
accagcacttttgga

SEQ ID NO: 83643 - DNA, 15 bp, Homo sapiens
ccagcacttttggag

SEQ ID NO: 83644 - DNA, 15 bp, Homo sapiens
cagcacttttggagg

SEQ ID NO: 83645 - DNA, 15 bp, Homo sapiens
agcacttttggaggc

SEQ ID NO: 83646 - DNA, 15 bp, Homo sapiens
gcacttttggaggcc

SEQ ID NO: 83647 - DNA, 15 bp, Homo sapiens
cacttttggaggcca

SEQ ID NO: 83648 - DNA, 15 bp, Homo sapiens
acttttggaggccaa

SEQ ID NO: 83649 - DNA, 15 bp, Homo sapiens
cttttggaggccaag

SEQ ID NO: 83650 - DNA, 15 bp, Homo sapiens
ttttggaggccaaga

SEQ ID NO: 83651 - DNA, 15 bp, Homo sapiens
tttggaggccaagat

SEQ ID NO: 83652 - DNA, 15 bp, Homo sapiens
ttggaggccaagatg

SEQ ID NO: 83653 - DNA, 15 bp, Homo sapiens
tggaggccaagatgg

SEQ ID NO: 83654 - DNA, 15 bp, Homo sapiens
ggaggccaagatggg

SEQ ID NO: 83655 - DNA, 15 bp, Homo sapiens
gaggccaagatggga

SEQ ID NO: 83656 - DNA, 15 bp, Homo sapiens
aggccaagatgggag

SEQ ID NO: 83657 - DNA, 15 bp, Homo sapiens
ggccaagatgggagg

SEQ ID NO: 83658 - DNA, 15 bp, Homo sapiens
gccaagatgggagga

SEQ ID NO: 83659 - DNA, 15 bp, Homo sapiens
ccaagatgggaggat

SEQ ID NO: 83660 - DNA, 15 bp, Homo sapiens
caagatgggaggatc
